United States Patent
Franklin et al.

(10) Patent No.: US 9,328,351 B2
(45) Date of Patent: May 3, 2016

(54) **GENETICALLY ENGINEERED MICROBIAL STRAINS INCLUDING *PROTOTHECA* LIPID PATHWAY GENES**

(71) Applicant: Solazyme, Inc., South San Francisco, CA (US)

(72) Inventors: Scott Franklin, La Jolla, CA (US); Shane Brubaker, El Cerrito, CA (US); George N. Rudenko, Mountain View, CA (US); Jeffrey L. Moseley, Redwood City, CA (US); Xinhua Zhao, Foster City, CA (US); Tina T. Huynh, Oakland, CA (US); Riyaz Bhat, South San Francisco, CA (US); Matthew Shoa-Azar, San Mateo, CA (US); Trung H. Nguyen, San Jose, CA (US); Karen Espina, San Francisco, CA (US); Aravind Somanchi, Redwood City, CA (US)

(73) Assignee: SOLAZYME, INC., South San Francisco, CA (US)

( * ) Notice: Subject to any disclaimer, the term of this patent is extended or adjusted under 35 U.S.C. 154(b) by 582 days.

(21) Appl. No.: 13/688,025

(22) Filed: Nov. 28, 2012

(65) Prior Publication Data
US 2013/0197247 A1  Aug. 1, 2013

Related U.S. Application Data

(60) Provisional application No. 61/564,247, filed on Nov. 28, 2011, provisional application No. 61/581,538, filed on Dec. 29, 2011, provisional application No. 61/674,251, filed on Jul. 20, 2012.

(51) Int. Cl.
*C12N 15/79* (2006.01)
*C12N 15/82* (2006.01)
*C07K 14/405* (2006.01)
*C12P 7/64* (2006.01)
*C12N 9/00* (2006.01)
*C12N 9/02* (2006.01)
*C12N 9/16* (2006.01)
*C12N 9/10* (2006.01)

(52) U.S. Cl.
CPC .............. *C12N 15/79* (2013.01); *C07K 14/405* (2013.01); *C12N 9/00* (2013.01); *C12N 9/0071* (2013.01); *C12N 9/1029* (2013.01); *C12N 9/16* (2013.01); *C12N 15/8247* (2013.01); *C12P 7/6445* (2013.01); *C12P 7/6463* (2013.01); *C12Y 114/19002* (2013.01); *C12Y 114/19006* (2013.01); *C12Y 203/01179* (2013.01); *C12Y 301/02014* (2013.01); *Y02P 20/52* (2015.11)

(58) Field of Classification Search
CPC ...... C12N 15/79; C12P 7/6463; C12P 7/6445
See application file for complete search history.

(56) References Cited

U.S. PATENT DOCUMENTS

| | | | |
|---|---|---|---|
| 4,945,050 A | 7/1990 | Sanford et al. | |
| 5,900,370 A | 5/1999 | Running | |
| 6,395,965 B1 | 5/2002 | Xia | |
| 7,135,290 B2 | 11/2006 | Dillon | |
| 8,187,860 B2 | 5/2012 | Franklin et al. | |
| 8,258,109 B2 * | 9/2012 | Bennett et al. | 514/44 A |
| 8,791,088 B2 * | 7/2014 | Bennett et al. | 514/44 A |
| 8,951,308 B2 * | 2/2015 | Ellis et al. | 44/500 |
| 2004/0236091 A1 * | 11/2004 | Chicz et al. | 536/23.5 |
| 2009/0203093 A1 * | 8/2009 | Steinbuchel et al. | 435/134 |
| 2009/0211150 A1 | 8/2009 | Wu et al. | |
| 2010/0021912 A1 * | 1/2010 | Farese et al. | 435/6 |
| 2010/0151112 A1 * | 6/2010 | Franklin et al. | 426/656 |
| 2011/0020889 A1 | 1/2011 | Feldman et al. | |
| 2011/0293785 A1 * | 12/2011 | Franklin et al. | 426/61 |
| 2011/0294174 A1 * | 12/2011 | Franklin et al. | 435/134 |
| 2012/0028319 A1 | 2/2012 | Trimbur et al. | |
| 2013/0280793 A1 * | 10/2013 | Brown et al. | 435/257.2 |
| 2013/0323780 A1 * | 12/2013 | Schneider et al. | 435/34 |
| 2014/0178950 A1 | 6/2014 | Franklin et al. | |

FOREIGN PATENT DOCUMENTS

| | | |
|---|---|---|
| WO | WO 2008/151149 A2 | 12/2008 |
| WO | WO 2009/105927 A1 | 9/2009 |
| WO | WO 2009/126843 A2 | 10/2009 |
| WO | WO 2010/045368 A2 | 4/2010 |
| WO | WO 2010/063031 A2 | 6/2010 |
| WO | WO 2010/063032 A2 | 6/2010 |
| WO | WO 2010/120939 A2 | 10/2010 |
| WO | WO 2010/147642 A1 | 12/2010 |
| WO | WO 2011/008565 A1 | 1/2011 |
| WO | WO 2011/150410 A2 | 12/2011 |
| WO | WO 2011/150411 A1 | 12/2011 |
| WO | WO 2012/106560 A1 | 8/2012 |
| WO | WO 2013/056212 A2 | 4/2013 |
| WO | WO 2013/082186 A2 | 6/2013 |
| WO | WO 2013/158938 A1 | 10/2013 |
| WO | WO 2014/089514 A1 | 6/2014 |

OTHER PUBLICATIONS

Hickenbottom, S.L., et al., 2004, "Structure of a lipid droplet protein: The PAT family member TIP47", Structure, vol. 12, pp. 1199-1207.*
Low, K.L., et al., 2010, "Lipid droplet-associated proteins are involved in the biosynthesis and hydrolysis of triacylglycerol in *Mycobacterium bovis* Bacillus Calmette-Guérin", The Journal of Biological Chemistry, vol. 285, No. 28, pp. 21662-21670.*
Moellering, E.R., et al., 2010, "RNA interference silencing of a major lipid droplet protein affects lipid droplet size in *Chlamydomonas reinhardtii*", Eukaryotic Cell, vol. 9, No. 1, pp. 97-106.*
Yang, X., et al., 2010, "Identification of Perilipin-2 as a lipid droplet protein regulated in oocytes during maturation", Reproduction, Fertility and Development, vol. 22, pp. 1262-1271.*

(Continued)

*Primary Examiner* — Manjunath Rao
*Assistant Examiner* — William W Moore
(74) *Attorney, Agent, or Firm* — Emily M. Haliday

(57) ABSTRACT

Genetically engineered microbial, e.g., *Prototheca*, cells provide microbial oil useful as a food additive and a source of renewable fuels and industrial chemicals.

13 Claims, 1 Drawing Sheet

(56) References Cited

OTHER PUBLICATIONS

Robenek, H., et al., 2011, "Topography of lipid droplet-associated proteins: Insights from freeze-fracture replica immunogold labeling", Journal of Lipids, vol. 2011, Article ID 409371.*
Vieler, A., et al., 2012, "A lipid droplet protein of Nannochloropsis with functions partially analogous to plant pleosins", Plant Physiology, vol. 158, pp. 1562-1569.*
Yang, H., et al., 2012, "Controlling the size of lipid droplets: lipid and protein factors", Current Opinion in Cell Biology, vol. 24, pp. 509-516.*
PCT Invitation to Pay Additional Fees and, Where Applicable, Protest Fee dated Apr. 12, 2013 issued in PCT/US2012/066893.
PCT International Search Report and Written Opinion dated Jul. 19, 2013 issued in PCT/US2012/066893.
PCT International Preliminary Report on Patentability dated Jun. 12, 2014 issued in PCT/US2012/066893.
Database Geneseq [Online] Aug. 5, 2010 "P. moriforims fatty acyl-ACP thioesterase-1 cDNA, SEQ:134.", XP002694485, retrieved from EBI accession No. GSN :AYC84244 Database accession No. AYC84244 sequence.
Database EMBL [Online] Sep. 17, 2010 "Chlorella variabilis hypothetical protein," XP002694486, retrieved from EBI accession No. EMBL:EFN58098 sequence, One page.
Chinese First Office Action dated Jul. 9, 2015 issued in CN 201280068060.6.
European Office Action dated Jul. 3, 2015 issued in EP 12 799 433.3.
European Office Action dated Sep. 10, 2015 issued in EP 12 799 433.3.
Mexican Office Action [no translation] dated Jun. 30, 2014 issued in MX/a/2014/006357.
PCT International Search Report and Written Opinion dated Mar. 24, 2014 issued in PCT/US2013/073718.
Mexican Office Action [no translation] dated Sep. 2, 2014 issued in MX/a/2014/006357.
PCT International Preliminary Report on Patentability and Written Opinion dated Jun. 18, 2015 issued in PCT/US2013/073718.
Abe et al., (2008) "Expression of Exogenous Genes Under the Control of Endogenous *HSP70* and *CAB* Promoters in the *Closterium peracerosum—strigosum—littorale* complex," Plant Cell Physiology, 49(4):625-632.
Abe et al., (2011) "Stable Nuclear Transformation of the *Closterium peracerosum—strigosum—littorale* Complex," Plant & Cell Physiology, 52(9):1676-1685.
Ando et al., (Sep. 2009) "Establishment of *Agrobacterium tumefaciens*—Mediated Transformation of an Oleaginous Fungus, *Mortierella alpina* 1S-4, and Its Application for Eicosapentaenoic Acid Producer Breeding," Applied and Environmental Biology, 75(17):5529-5535.
Apt et al., (1996) "Stable nuclear transformation of the diatom *Phaeodactylum tricornutum*," Molecular and General Genetics, 252:572-579.
Armbrust et al.,(Oct. 1, 2004) "The Genome of the Diatom *Thalassiosira pseudonana*: Ecology, Evolution, and Metabolism," Science, 306(5693):79-86.
Boyle et al., (May 4, 2012) "Three Acyltransferases and Nitrogen-responsive Regulator Are Implicated in Nitrogen Starvation-induced Triacylglycerol Accumulation in *Chlamydomonas*," The Journal of Biological Chemistry, 287(19):15811-15825.
Brown, L.M., (1982) "Production of axenic cultures of algae by an osmotic method," Phycologia, 21(3):408-410.
Cerutti et al., (Jan. 1997) "A Eubacterial Gene Conferring Spectinomycin Resistance on *Chlamydomonas reinhardtii*: Integration Into the Nuclear Genome and Gene Expression," Genetics,145(1):97-110.
Chen et al., (1988) "Recognition of prokaryotic transcription terminators by spinach chloroplast RNA polymerase," Nucleic Acids Research,16(17):8411-8431.

Chen et al., (2001) "Highly efficient expression of rabbit neutrophil peptide-1 gene in *Chlorella ellipsoidea* cells," Current Genetics, 39(5):365-370.
Cho et al., (2007) "Optimum temperature and salinity conditions for growth of green algae *Chlorella ellipsoidea* and *Nannochloris oculata*," Fisheries Science, 73(5):1050-1056.
Chow et al., (1999) "Electrotransformation of *Chlorella vulgaris*," Plant Cell Reports, 18:778-780.
Courchesne, Noémie Manuelle Dorval el al., (2009) "Enhancement of lipid production using biochemical, genetic and transcription factor engineering approaches," Journal of Biotechnology, 141(1):31-41.
Dawson et al.,(1997) "Stable Transformation of *Chlorella*: Rescue of Nitrate Reductase-Deficient Mutants with the Nitrate Reductase Gene," Current Microbiol., 35(6):356-362.
Deng et al., (Feb. 4, 2011) "The effects of nutritional restriction on neutral lipid accumulation in *Chlamydomonas* and *Chlorella*," African Journal of Microbiology Research, 5(3):260-270.
El-Sheekh et al., (1999) "Stable transformation of the intact cells of *Chlorella kessleri* with high velocity microprojectiles," Biologia Plantarium, 42:(2):209-216.
Ewing et al., (2014) "16S and 23S Plastid RDNA Phylogenies of *Prototheca* Species and Their Auxanographic Phenotypes," J Phycol.,50(4):765-769, Epub Jul. 10, 2014.
Ewing et al., (2013) "Whole genome sequencing and phylogeny for members of the microalgae genus *Prototheca*," Abstract and Poster presented on Nov. 12, 2013 at the Functional and Comparative Genomics & Pharmacogenomics Conference in Chicago, 2pp.
Fromm et al., (Sep. 1985) "Expression of genes transferred into monocot and dicot plant cells by electroporation," Proc. Natl. Acad. Sci. USA, 82:5824 5828.
Gao et al. (Jul. 10, 2014) "Oil accumulation mechanisms of the oleaginous microalga *Chlorella protothecoides* revealed through its genome, transcriptomes, and proteomes," BMC Genomics, 15:582, 14pp.
Hallamann et al., (Nov. 1994) "Reporter genes and highly regulated promoters as tools for transformation experiments in *Volvox carteri*," Proc. Natl. Acad. Sci. USA, 91:11562-11566.
Hawkins et al., (1999) "Expression of Human Growth Hormone by the Eukaryotic Alga, *Chlorella*," Current Microbiology, 38:335-341.
Holder et al., (Sep. 2011) "Comparative and Functional Genomics of *Rhodococcus opacus* PD630 for Biofuels Development," PLOS Genetics, 7(9):e1002219, 18pp.
Huang et al. (2006) "Expression of mercuric reductase from *Bacillus megaterium* MB1 in eukaryotic microalga *Chlorella* sp. DT: an approach for mercury phytoremediation," Appl. Microbiol. Biotechnol. 72:197-205.
Iglesias-Prieto et al., (Nov. 1992) "Photosynthetic response to elevated temperature in the symbiotic dinoflagellate *Symbiodinium microadriaticum* in culture," Proceedings of the National Academy of Sciences, 89(21):10302-10305.
Jakobiak et al. (Dec. 2004) "The Bacterial Paromomycin Resistance Gene, *aphH*, as a Dominant Selectable Marker in *Volvox carteri*," Protist,155(4):381-393.
Jarvis et al. (1991) "Transient expression of firefly luciferase in protoplasts of the green alga *Chlorella ellipsoidea*," Current Genetics, 19:317-321.
Kalscheuer et al., (1999) "Establishment of a gene transfer system for *Rhodococcus opacus* PD630 based on electroporation and its application for recombinant biosynthesis of poly(3-hydroxyalkanoic acids)," Applied and Environmental Microbiology, 52:508-515.
Kang et al., (2004) "Genetic diversity in chlorella viruses flanking *kcv*, a gene that encodes a potassium ion channel protein," Virology, 326(1):150-159.
Kawasaki et al., (2004) "Immediate early genes expressed in chlorovirus infections," Virology,318(1):214-223.
Kilian et al., (Dec. 27, 2011) "High-efficiency homologous recombination in the oil-producing alga *Nannochloropsis* sp.," Proceedings of the National Academy of Sciences, 108(52):21265-21269.
Kim et al., (2002) Stable Integration and Functional Expression of Flounder Growth Hormone Gene in Transformed Microalga, *Chlorella ellipsoidea*, Mar. Biotechnol., 4(1):63-73.

(56) References Cited

OTHER PUBLICATIONS

Kobayashi et al., (Mar. 1993) "Enhanced Carotenoid Biosynthesis by Oxidative Stress in Enhanced Carotenoid Biosynthesis by Oxidative Stress in Acetate-Induced Cyst Cells of a Green Unicellular Alga, *Haematococcus pluvialis*," *Applied and Environmental Microbiology*, 59(3):867-873.
Lerche et al., (2009) "Stable nuclear transformation of Gonium pectorale," *BMC Biotechnology*, 9(64):21pp.
Levitan et al., (Apr. 26, 2005) "Dual targeting of the protein disulfide isomerase RB60 to the chloroplast and the endoplasmic reticulum," *Proc. Natl. Acad. Sci. USA*,102(17):6225-6230.
Lumbreras et al., (1998) "Efficient foreign gene expression in *Chlamydomonas reinhardtii* mediated by an endogenous intron," *Plant Journal*, 14(4):441-447.
MacKenzie et al., (Nov. 2000) "Isolation and Use of a Homologous Histone H4 Promoter and a Ribosomal DNA Region in a Transformation Vector for the Oil-Producing Fungus *Mortierella alpina*," *Applied and Environmental Microbiology*, 66(11):4655-4661.
Merchant et al., (Oct. 12, 2007) "The *Chlamydomonas* Genome Reveals the Evolution of Key Animal and Plant Functions," *Science*, 318(5848):245-250.
Mitra et al., (Oct. 14, 1994) "A Chlorella Virus Gene Promoter Functions as a Strong Promoter Both in Plants and Bacteria," *Biochemical Biophysical Research Communication*, 204(1):187-194.
Mitra et al., (Oct. 1994) "The *Chlorella* virus adenine methyltransferase gene promoter is a strong promoter in plants," *Plant Mol. Biol.*, 26(1):85-93.
Peled et al. (2011) "Isolation of a Novel Oil Globule Protein from the Green Alga *Haematococcus pluvialis* (Chlorophyceae)," *Lipids*, 46(9):851-861.
Pignede et al., (Aug. 2000) "Autocloning and Amplification of *LIP2* in *Yarrowia lipolytica*," *Applied and Environmental Biology*, 66(8):3283-3289.
Pore, (Oct. 1973) "Selective Medium for the Isolation of *Prototheca*," *App. Microbiology*, 26(4):648-649.
Poulsen et al., (2005) "A new molecular tool for transgenic diatoms Control of mRNA and protein biosynthesis by an inducible promoter—terminator cassette," *FEBS Journal*, 272:3413-3423.
Prochnik et al., (Jul. 9, 2010) "Genomic Analysis of Organismal Complexity in the Multicellular Green Alga *Volvox carteri*," *Science*, 329:223-226.
Pröschold et al., (Aug. 2005) "Portrait of a species: *Chlamydomonas reinhardtii*," *Genetics*,170:1601-1610.
Radakovits et al., (Apr. 2010) "Genetic Engineering of Algae for Enhanced Biofuel Production," *Eukaryotic Cell*, 9(4):486-501.
Radakovits et al., (Feb. 21, 2012) "Draft genome sequence and genetic transformation of the oleaginous alga *Nannochloropsis gaditana*," *Nature Communications*, 3:686 Article No. 10.1038, 10 pages.
Rosenberg, Julian N. et al., (2008) "A green light for engineered algae: redirecting metabolism to fuel a biotechnology revolution," *Current Opinion in Biotechnology*, 19(5):430-436.
Sanford, (Dec. 1998) "The biolistic process," *Trends in Biotech.* 6:299-302.
Schultz et al., (Apr. 2005) "A common core of secondary structure of the internal transcribed spacer 2 (ITS2) throughout the Eukaryota," *RNA*, 11(4):361-364.
Sekimoto et al., (2003) "Expressed Sequence Tags from the *Closterium peracerosum—strigosum—littorale* complex, a Unicellular Charophycean Alga, in the Sexual Reproduction Process," *DNA Research*, 10(4):147-153.
Steinbrenner et al., (Dec. 2006) "Transformation of the Green Alga *Haematococcus pluvialis* with a Phytoene Desaturase for Accelerated Astaxanthin Biosynthesis," *Applied and Environmental Microbiology*, 72(12):7477-7484.
Tan et al., (Aug. 2005) "Establishment of a Micro-Particle Bombardment Transformation System for *Dunaliella salina*," *The Journal of Microbiology*, 43(4):361-365.
Walker et al., (2005) "Characterisation of the *Dunaliella tertiolecta* RbcS genes and their promoter activity in *Chlamydomonas reinhardtii*," *Plant Cell Rep.* 23(10-11):727-735.
Wang et al., (Dec. 2011) "Genome Characterization of the Oleaginous Fungus *Mortierella alpina*," *PLOS One*, 6(12):e28319, 16pp.
Wu et al., (2001) "Identification of *Chlorella* spp. isolates using ribosomal DNA sequences," *Bot. Bull. Acad. Sin.*42:115-121.
Yan et al., (2015) "*Auxenochlorella protothecoides* and *Prototheca wickerhamii* plastid genome sequences give insight into the origins of non-photosynthetic algae," *Scientific Reports*,5:14465, 8pp.
Zaslavskaia et al. (Jun. 15, 2001) "Trophic Conversion of an Obligate Photoautotrophic Organism Through Metabolic Engineering," *Science*, 292:2073-2075.

\* cited by examiner too long deletion, chromosomal gene insertion, frameshift mutation, point mutation, and/or inhibitory RNA. The genetically engineered cell can, in certain embodiments, further comprise an exogenous *Prototheca* lipid biosynthesis pathway gene selected from the genes listed in Table 1. In particular embodiments, one or more allele(s) of an endogenous lipid biosynthesis gene in the genetically engineered cell is attenuated.

In certain embodiments, one allele of the endogenous lipid biosynthesis gene is replaced, in the genetically engineered cell, with a polynucleotide encoding, e.g., an exogenous *Prototheca* lipid biosynthesis pathway gene selected from Table 1 and a selectable marker. In a variation of this embodiment, two or more alleles of the endogenous lipid biosynthesis gene are each replaced with a polynucleotide encoding an exogenous *Prototheca* lipid biosynthesis pathway gene selected from Table 1 and a selectable marker. In certain embodiments, the genetically engineered cell has a 23S rRNA sequence with at least 75%, 80%, 85%, 90%, 95%, 96%, 97%, 98%, or 99% nucleotide identity to SEQ ID NO: 5. In particular embodiments, the genetically engineered cell is a *Prototheca* cell, wherein the cell has a fatty acid profile that is at least 10% C8-C14. In some embodiments, the cell has a fatty acid profile that is at least 50%, 60%, or 70% C12:0. In some embodiments, the cell has a fatty acid profile that is at least at least 70%, 75%, 80%, 85%, or 90% C18:1. In certain embodiments, the invention also provides a method for obtaining microbial oil comprising culturing this genetically engineered cell, which may be, e.g., a *Prototheca* cell, under conditions such that oil is produced. In certain embodiments, the microbial oil thus produced has a fatty acid profile that is at least 10% C8-C14. The invention also includes a microbial oil produced by this method.

In another aspect, the present invention provides a genetically engineered microbial cell, e.g., *Prototheca* cell, in one or more lipid biosynthesis genes have been modified to increase or decrease expression of such one or more genes such that the fatty acid profile of the genetically engineered strain differs from that of the strain from which it was derived. In one embodiment, at least two genes have been modified. In various embodiments, the genetic modifications include one or more of the following modifications: (i) attenuation of a gene or its enzymatic product; and (ii) increased expression of a gene or its enzymatic product; (iii) altered activity of a gene or its enzymatic product.

In various embodiments, the genetically engineered cell has one or more attenuated genes, wherein the genes attenuated have been attenuated by a means selected from the group consisting of a homologous recombination event and introduction of an exogenous gene that codes for an interfering RNA. In various embodiments, one or more alleles of a gene are attenuated.

In various embodiments, the genetically engineered cell has one or more over-expressed genes, wherein the genes over-expressed have been up-regulated by a means selected from the group consisting of introduction of additional copies of said gene into said cell; introduction of new expression control elements for said gene; and alteration of the protein-coding sequence of the gene. In various embodiments, one or more alleles of a gene are over-expressed.

In various embodiments, the modified genes of the genetically engineered cell are selected from the group consisting of *Prototheca* lipid biosynthesis genes presented in Table 1. In various embodiments, the genetically engineered cell comprises an exogenous gene selected from the group consisting of *Prototheca* lipid biosynthesis genes presented in Table 1. In various embodiments, the genetically engineered cell comprises one or more overexpressed alleles of a gene, the gene selected from the group consisting of *Prototheca* lipid biosynthesis genes presented in Table 1. In various embodiments, the genetically engineered cell has an attenuated gene selected from the group consisting of *Prototheca* lipid biosynthesis genes presented in Table 1. In various embodiments, the genetically engineered cell has one more attenuated alleles of a gene, the gene selected from the group consisting of *Prototheca* lipid biosynthesis genes presented in Table 1.

In various embodiments, the genetically engineered cell has a fatty acid profile selected from the group consisting of: 3% to 60% C8:0, 3% to 60% C10:0, 3% to 70% C12:0, 3% to 95% C14:0, 3% to 95% C16:0, 3% to 95% C18:0, 3% to 95% C18:1, 0% to 60% C18:2, 0% to 60% C18:3 or combinations thereof. In various embodiments, the ratio of C10:0 to C12:0 is at least 3:1. In some cases, the ratio of C10:0 to C14:0 is at least 10:1. In various embodiments, the ratio of C12:0 to C14:0 is at least 3:1. In various embodiments, the genetically engineered cell has a fatty acid profile of at least 40% saturated fatty acids, of at least 60% saturated fatty acids, or at least 85% saturated fatty acids.

In another aspect, the present invention provides methods for obtaining microbial oil comprising culturing a genetically engineered *Prototheca* cell of the invention under conditions such that oil is produced. In various embodiments, the microbial oil has a fatty acid profile selected from the group consisting of: 3% to 40% C8:0, 3% to 60% C10:0, 3% to 70% C12:0, 3% to 95% C14:0, 3% to 95% C16:0, 3% to 95% C18:0, 3% to 95% C18:1, 0% to 60% C18:2, 0% to 60% C18:3 or combinations thereof. In various embodiments, the ratio of C10:0 to C12:0 is at least 3:1. In some cases, the ratio of C10:0 to C14:0 is at least 10:1. In various embodiments, the ratio of C12:0 to C14:0 is at least 3:1. In various embodiments, the genetically engineered cell has a fatty acid profile of at least 40% saturated fatty acids, of at least 60% saturated fatty acids, or at least 85% saturated fatty acids.

In an additional aspect, the present invention provides microbial oils and foods, fuels, and chemicals containing said oil or a chemical derived therefrom.

In another aspect, the present invention provides recombinant nucleic acids useful in methods for making genetically modified *Prototheca* and other cells. The nucleic acids of the invention comprise all or some portion of a *Prototheca* lipid biosynthesis gene.

In various embodiments, these nucleic acids include expression cassettes, which consist of a coding sequence and control sequences that regulate expression of the coding sequence, which may code for an mRNA that encodes a lipid biosynthesis protein, enzyme, or for an RNAi that acts to suppress expression of a lipid biosynthesis gene.

In other embodiments, these nucleic acids are expression vectors that include one or more expression cassettes and stably replicate in a *Prototheca* or other host cell, either by integration into chromosomal DNA of the host cell or as freely replicating vectors.

In other embodiments, these nucleic acids comprise only a portion of a *Prototheca* lipid biosynthesis gene, which portion may be a portion of a coding sequence, an exon, or a control element. Such nucleic acids are useful in the construction of expression cassettes for *Prototheca* and non-*Prototheca* host cells, for integration of exogenous DNA into *Prototheca* host cells, and for construction of nucleic acids useful for attenuating *Prototheca* lipid biosynthetic genes by homologous recombination.

In some embodiments, provided are sequences, compositions, host cells, and methods for overexpression of a lipid biosynthesis gene. In some aspects, the overexpressed lipid biosynthesis gene is one or more of LEC2, DGAT, ATP:citrate lyase (ACL), malic enzyme, lipase, fatty acyl-CoA reductase, Acyl-CoA Binding Proteins (ACBPs), or Lipoic Acid Synthase (LS1).

These and other aspects and embodiments of the invention are described in the accompanying drawings, a brief description of which immediately follows, the detailed description of the invention below, and are exemplified in the examples below. Any or all of the features discussed above and throughout the application can be combined in various embodiments of the present invention.

DETAILED DESCRIPTION

Figure 1:
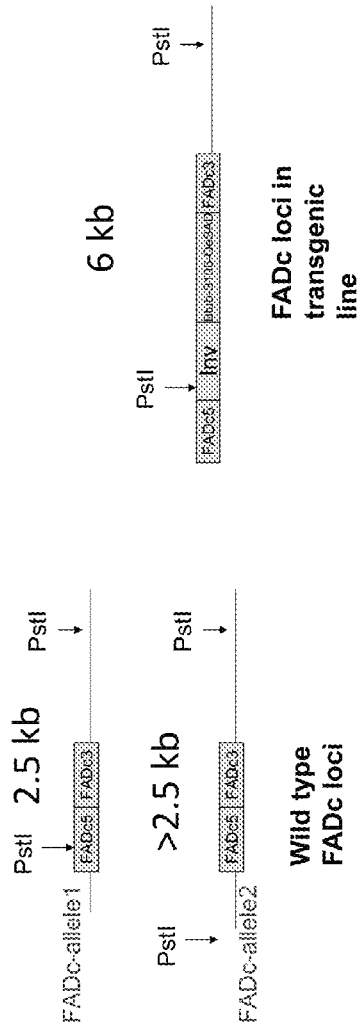
FIG. 1 shows PstI restriction maps of *Prototheca moriformis* FADc alleles with and without a targeted gene disruption, as described in Example 37.

For the convenience of the reader, this detailed description of the invention is divided into sections. Section I provides definitions of terms used herein. Section II provides an overview of the *Prototheca* lipid biosynthesis pathway. Section III describes culturing methods for *Prototheca* cells of the invention. Section IV describes genetic engineering methods for *Prototheca* and genetically engineered cells of the invention. Section V describes microbial oils provided by the invention. Section VI describes nucleic acids of the invention.

Section I. Definitions

Unless defined otherwise, all technical and scientific terms used herein have the meaning commonly understood by a person skilled in the art to which this invention belongs. The following references provide one of skill with a general definition of many of the terms used in this invention: Singleton et al., *Dictionary of Microbiology and Molecular Biology* (2nd ed. 1994); *The Cambridge Dictionary of Science and Technology* (Walker ed., 1988); *The Glossary of Genetics*, 5th Ed., R. Rieger et al. (eds.), Springer Verlag (1991); and Hale & Marham, *The Harper Collins Dictionary of Biology* (1991). As used herein, the following terms have the meanings ascribed to them unless specified otherwise.

A nucleic acid "active in microalgae" refers to a nucleic acid that is functional in microalgae. For example, a promoter that has been used to drive an antibiotic resistance gene to impart antibiotic resistance to a transgenic microalgae is active in microalgae.

"Acyl carrier protein" or "ACP" is a protein that binds a growing acyl chain during fatty acid synthesis as a thiol ester at the distal thiol of the 4'-phosphopantetheine moiety and comprises a component of the fatty acid synthase complex.

"Acyl-CoA molecule" or "acyl-CoA" is a molecule comprising an acyl moiety covalently attached to coenzyme A through a thiol ester linkage at the distal thiol of the 4'-phosphopantetheine moiety of coenzyme A.

"Allele" refers to one or two or more forms of a gene or genetic locus. Alleles of a gene may share 100% or less nucleotide sequence identity. Gene products encoded by alleles of a gene may share 100% or less amino acid sequence identity. Overexperession of different alleles of a gene and/or the gene products encoded therein may confer different phenotypes to a genetically engineered organism. Attenuation of different alleles of a gene and/or the gene products encoded therein may confer different phenotypes to a genetically engineered organism.

"Attenuation of a Gene" refers to (i) genetically engineering a gene so that it has, relative to a wild-type gene, different control sequences that result in decreased amounts of a gene product (RNA including mRNA, inhibitory RNA molecules, and other RNAs, polypeptides); (ii) genetically engineering a cell so that it has, relative to a wild-type cell, fewer or no detectable copies of a gene and decreased amounts of the corresponding gene product; and/or (iii) genetically engineering the coding sequence of a gene to either decrease the stability and/or activity of the gene product (i.e., if the increase the stability of an RNA gene product, increase translation of an mRNA gene product, and/or decrease the level of enzymatic activity of a protein encoded by the mRNA gene product, i.e., by making the protein less stable or less active (which may also be referred to as "attenuation of an Enzymatic Product"). An "Attenuated Gene Product" is the gene product of attenuation of a gene by any of the foregoing methods. An "Attenuated Gene" is a gene that has been genetically engineered by one or more of the methods described herein that results in decreased amounts of gene product. Attenuation of a gene thus results in "Decreased Expression of a Gene", "down-regulation of the gene", or "inactivation of the gene".

"Axenic" is a culture of an organism substantially free from contamination by other living organisms.

"Biomass" is material produced by growth and/or propagation of cells. Biomass may contain cells and/or intracellular contents as well as extracellular material, includes, but is not limited to, compounds secreted by a cell.

"Catalyst" is an agent, such as a molecule or macromolecular complex, capable of facilitating or promoting a chemical reaction of a reactant to a product without becoming a part of the product. A catalyst increases the rate of a reaction, after which, the catalyst may act on another reactant to form the product. A catalyst generally lowers the overall activation energy required for the reaction such that it proceeds more quickly or at a lower temperature. Thus, a reaction equilibrium may be more quickly attained. Examples of catalysts include enzymes, which are biological catalysts; heat, which is a non-biological catalyst; and metals used in fossil oil refining processes.

"Co-culture", and variants thereof such as "co-cultivate" and "co-ferment", refer to the presence of two or more types of cells in the same bioreactor. The two or more types of cells may both be microorganisms, such as microalgae, or may be a microalgal cell cultured with a different cell type. The culture conditions may be those that foster growth and/or propagation of the two or more cell types or those that facilitate growth and/or proliferation of one, or a subset, of the two or more cells while maintaining cellular growth for the remainder.

"Coding Sequence" refers to that portion of a gene or expression cassette that encodes the RNA transcribed from that gene or expression cassette in a cell, specifically that portion of the mRNA that is translated into the protein encoded by that mRNA. Any non-translated portions of a gene between translated portions are referred to as "introns".

"Cofactor" or "co-factor" is any molecule, other than the substrate, required for an enzyme to carry out its enzymatic activity.

"Complementary DNA" or "cDNA" is a DNA copy of mRNA, usually obtained by reverse transcription of messenger RNA (mRNA) or amplification (e.g., via polymerase chain reaction ("PCR")).

"Control Sequence" refers to nucleic acid sequences in a gene or expression cassette that regulate transcription of a coding sequence and so include promoters, enhancers, transcription termination sequences, and translation initiation sequences.

"Cultivated", and variants thereof such as "cultured" and "fermented", refer to the intentional fostering of growth (increases in cell size, cellular contents, and/or cellular activity) and/or propagation (increases in cell numbers via mitosis) of one or more cells by use of selected and/or controlled conditions. The combination of both growth and propagation may be termed proliferation. Examples of selected and/or controlled conditions include the use of a defined medium (with known characteristics such as pH, ionic strength, and carbon source), specified temperature, oxygen tension, carbon dioxide levels, and growth in a bioreactor. Cultivate does not refer to the growth or propagation of microorganisms in nature or otherwise without human intervention; for example, natural growth of an organism that ultimately becomes fossilized to produce geological crude oil is not cultivation.

"Cytolysis" is the lysis of cells in a hypotonic environment. Cytolysis is caused by excessive osmosis, or movement of water, towards the inside of a cell (hyperhydration). The cell cannot withstand the osmotic pressure of the water inside, and so it explodes.

"Delipidated meal" and "delipidated microbial biomass" is microbial biomass after oil (including lipids) has been extracted or isolated from it, either through the use of mechanical (i.e., exerted by an expeller press) or solvent extraction or both. Delipidated meal has a reduced amount of oil/lipids as compared to before the extraction or isolation of oil/lipids from the microbial biomass but does contain some residual oil/lipid.

"Desaturase" are enzymes in the lipid synthesis pathway responsible for the introduction of double bonds (unsaturation) into the fatty acid chains of fatty acid or triacylglyceride molecules. Examples include but are not limited to stearoyl-Acyl carrier protein desaturase (SAD) and fatty acid desaturase (FAD), also known as fatty acyl desaturase.

"Expression Cassette" refers to a coding sequence and a promoter, optionally in combination with one or more control sequences. Expression cassettes for enzymes include, for example and without limitation, a translation initiation control sequence.

"Expression vector" or "expression construct" or "plasmid" or "recombinant DNA construct" refer to a nucleic acid that has been generated via human intervention, including by recombinant means or direct chemical synthesis, with a series of specified nucleic acid elements that permit transcription and/or translation of a particular nucleic acid in a host cell. The expression vector may be part of a plasmid, virus, or nucleic acid fragment. Typically, the expression vector includes a nucleic acid to be transcribed operably linked to a promoter. Some expression cassettes are expression vectors, but expression vectors often contain more than one expression cassette, for example expression cassettes for selectable markers are sometimes included in expression vectors for introducing exogenous genes into host cells. One of skill in the art understands that a "recombinant nucleic acid" that encodes a particular gene, or portion thereof, is isolated from the specific context in which it naturally occurs.

"Exogenous gene" is a nucleic acid that codes for the expression of an RNA and/or protein that has been introduced ("transformed") into a cell, and is also referred to as a "transgene". A transformed cell may be referred to as a recombinant cell, into which additional exogenous gene(s) may be introduced. The exogenous gene may be from a different species (and so heterologous), or from the same species (and so homologous), relative to the cell being transformed. Thus, an exogenous gene can include a homologous gene that occupies a different location in the genome of the cell or is under different control, relative to the endogenous copy of the gene. An exogenous gene may be present in more than one copy in the cell. An exogenous gene may be maintained in a cell as an insertion into the genome (nuclear or plastid) or as an episomal molecule.

"Exogenously provided" refers to a molecule provided to the culture media of a cell culture.

"Expeller pressing" is a mechanical method for extracting oil from raw materials such as soybeans and rapeseed. An expeller press is a screw type machine, which presses material through a caged barrel-like cavity. Raw materials enter one side of the press and spent cake exits the other side while oil seeps out between the bars in the cage and is collected. The machine uses friction and continuous pressure from the screw drives to move and compress the raw material. The oil seeps through small openings that do not allow solids to pass through. As the raw material is pressed, friction typically causes it to heat up.

"Fatty acids" shall mean free fatty acids, fatty acid salts, or fatty acyl moieties in a glycerolipid.

"Fatty acid modification enzyme" or "fatty acid modifying enzyme" refers to an enzyme that alters the covalent structure of a fatty acid. Examples of fatty acid modification enzymes include lipase, fatty acyl-CoA/aldehyde reductase, fatty acyl-CoA reductase, fatty aldehyde reductase, fatty aldehyde decarbonylase.

"Fatty acid profile" refers to the distribution of fatty acids in a cell or oil derived from a cell in terms of chain length and/or saturation pattern. In this context the saturation pattern can comprise a measure of saturated versus unsaturated acid or a more detailed analysis of the distribution of the positions of double bonds in the various fatty acids of a cell. The fatty acid profile in be readily determined, for example by using gas chromatography. In one method, the fatty acids of the triacylglycerol are converted into a fatty acid methyl ester (FAME) using well known methods. The FAME molecules are then detected by gas chromatography. For example, a separate peak is observed for a fatty acid of 14 carbon atoms with no unsaturation (C14:0) compared to any other fatty acid such as C14:1. The peak area for each class of FAME determined using GC-FID is proportional to the weight percentages of the fatty acids. Unless specified otherwise, the fatty acid profile is expressed as a weight percent of the total fatty acid content. When referring to fatty acid profiles, "at least 4% C8-C14" means that at least 4% by weight of the total fatty acids in a cell or in an extracted glycerolipid composition have a chain length that includes 8, 10, 12 or 14 carbon atoms.

"Fatty acid synthesis enzyme" refers to an enzyme that alters the chain length, saturation, or functional group modification of a fatty acid, or can otherwise lead to an altered fatty acid profile in a cell. Examples of fatty acid synthesis enzymes include fatty acyl-ACP thioesterase, desaturase, including stearoyl acyl carrier protein desaturase (SAD) and fatty acyl destaurase (FAD), fatty acyl hydroxylase, and β-keto-acyl-ACP synthase.

"Fatty acyl-ACP thioesterase" is an enzyme that catalyzes the cleavage of a fatty acid from an acyl carrier protein (ACP) during fatty acid synthesis.

"Fatty acyl-CoA/aldehyde reductase" is an enzyme that catalyzes the reduction of an acyl-CoA molecule to a primary alcohol.

"Fatty acyl-CoA reductase" is an enzyme that catalyzes the reduction of an acyl-CoA molecule to an aldehyde.

"Fatty aldehyde decarbonylase" is an enzyme that catalyzes the conversion of a fatty aldehyde to an alkane.

"Fatty aldehyde reductase" is an enzyme that catalyzes the reduction of an aldehyde to a primary alcohol.

"Fixed carbon source" is a molecule(s) containing carbon, typically an organic molecule, that is present at ambient temperature and pressure in solid or liquid form in a culture media that may be utilized by a microorganism cultured therein.

"Functional protein" refers to a protein whose its activity has been retained even though it may be attenuated.

"Genetically engineered", "genetically engineer", and "genetic engineering" refers to alteration of the DNA and/or RNA of a living cell by human intervention. Typically, the alteration is mediated by the introduction of one or more expression vectors, but in some instances, functionally equivalent alterations may be achieved by mutagenesis alone.

"Glycerolipid" refers to a glycerol molecule esterified at the sn-1, sn-2 or sn-3 position of the glycerol with one or more phosphate, fatty acid, phosphoserine, phosphocholine, phosphoinositol, or phosphoethanolamine, or other moieties covalently attached to the glycerol backbone. Examples of glycerolipids include triacylglycerides (triglycerides), diacylglycerides (diglycerides), monoacylglycerides (monoglycerides), glycerol-3-phosphate, lysophosphatidic acid, phosphatidic acid, phosphatidylcholine, phosphatidylserine, phosphatidylglycerol, and phosphatidylethanolamine.

"Glycerolipid synthesis enzyme" refers to an enzyme involved in the synthesis of glycerolipids. Glycerolipid synthesis enzymes function, for example, to covalently attach acyl groups to a substituted glycerol. Examples of glycerolipid synthesis enzymes include glycerol-3-phosphate acyltransferase, lysophosphatidic acid acyltransferase, diacylglycerol acyltransferase, phospholipid diacylglycerol acyltransferase, and phosphatidic acid phosphatase.

"Glycerophospholipid" is a glycerolipid that at the sn-1, sn-2 or sn-3 positions of the glycerol backbone has at least one or more covalently bound phosphate or a covalently bound phosphate containing moiety, for example, phosphocholine, phosphoserine, phosphoinositol, and phosphoethanolamine. Glycerophospholipids include phosphoglycerol, lysophosphatidic acid, phosphatidic acid, phosphatidylcholine, phosphatidylserine, phosphatidylglycerol, and phosphatidylethanolamine.

"Heterotrophic" as it pertains to culture conditions is culturing in the substantial absence of light while utilizing or metabolizing a fixed carbon source.

"Homogenate" is biomass that has been physically disrupted.

"Hydrogen:carbon ratio" is the ratio of hydrogen atoms to carbon atoms in a molecule on an atom-to-atom basis. The ratio may be used to refer to the number of carbon and hydrogen atoms in a hydrocarbon molecule. For example, the hydrocarbon with the highest ratio is methane $CH_4$ (4:1).

"Hydrophobic fraction" is the portion, or fraction, of a material that is more soluble in a hydrophobic phase in comparison to an aqueous phase. A hydrophobic fraction is substantially insoluble in water and usually non-polar.

"Increase lipid yield" refers to an increase in the productivity of a microbial culture by, for example, increasing dry weight of cells per liter of culture, increasing the percentage of cells that constitute lipid, or increasing the overall amount of lipid per liter of culture volume per unit time.

"Inducible promoter" is a promoter that mediates transcription of an operably linked gene in response to a particular stimulus. Examples of such promoters may be promoter sequences that are induced in conditions of changing pH or nitrogen levels.

"In operable linkage" is a functional linkage between two nucleic acid sequences, such a control sequence (typically a promoter) and the linked sequence (typically a sequence that encodes a protein, also called a coding sequence). A promoter is in operable linkage with an exogenous gene if it can mediate transcription of the gene.

"In situ" means "in place" or "in its original position".

"Limiting concentration of a nutrient" is a concentration of a compound in a culture that limits the propagation of a cultured organism. A "non-limiting concentration of a nutrient" is a concentration that supports maximal propagation during a given culture period. Thus, the number of cells produced during a given culture period is lower in the presence of a limiting concentration of a nutrient than when the nutrient is non-limiting. A nutrient is said to be "in excess" in a culture, when the nutrient is present at a concentration greater than that which supports maximal propagation.

"Lipase" is a water-soluble enzyme that catalyzes the hydrolysis of ester bonds in water-insoluble, lipid substrates. Lipases catalyze the hydrolysis of lipids into glycerols and fatty acids.

"Lipids" are a class of molecules that are soluble in nonpolar solvents (such as ether and chloroform) and are relatively or completely insoluble in water. Lipid molecules have these properties, because they consist largely of long hydrocarbon tails which are hydrophobic in nature. Examples of lipids include fatty acids (saturated and unsaturated); glycerides or glycerolipids (such as monoglycerides, diglycerides, triglycerides or neutral fats, and phosphoglycerides or glycerophospholipids); nonglycerides (sphingolipids, sterol lipids including cholesterol and steroid hormones, prenol lipids including terpenoids, fatty alcohols, waxes, and polyketides); and complex lipid derivatives (sugar-linked lipids, or glycolipids, and protein-linked lipids). As used herein, the term "triacylglycerides" and "triglycerides" are interchangeable. "Fats" and "oils" are a subgroup of lipids called "triacylglycerides." "Oil," as distinguished from "fat" refers to triacylglycerides that are generally liquid at ordinary room temperature and pressure. Fatty acids are conventionally named by the notation that recites number of carbon atoms and the number of double bonds separated by a colon. For example oleic acid can be referred to as C18:1 and capric acid can be referred to as C10:0.

"Lipid biosynthesis pathway" or "lipid biosynthetic pathway" or "lipid metabolic pathway" or "lipid pathway" refers to the synthesis or degradation of lipids. Thus enzymes of the lipid biosynthesis pathway (e.g. lipid pathway enzyme) include fatty acid synthesis enzymes, fatty acid modification enzymes, and glycerolipid synthesis enzymes, as well as proteins (e.g. lipid pathway protein) that affect lipid metabolism, i.e., either lipid modification or degradation, and any proteins that chemically modify lipids, as well as carrier proteins. Lipid biosynthesis proteins also include transcription factors and kinases that are involved in lipid metabolism.

"Lipid biosynthesis gene" is any gene that encodes a protein that is involved in lipid metabolism, either in lipid synthesis, modification, or degradation, and any protein that chemically modifies lipids including carrier proteins.

"Lipid pathway enzyme" is any enzyme that plays a role in lipid metabolism, i.e., either lipid synthesis, modification, or degradation, and any proteins that chemically modify lipids, as well as carrier proteins.

"Lysate" is a solution containing the contents of lysed cells.

"Lysis" is the breakage of the plasma membrane and optionally the cell wall of a biological organism sufficient to release at least some intracellular content, often by mechanical, viral or osmotic mechanisms that compromise its integrity.

"Lysing" is disrupting the cellular membrane and optionally the cell wall of a biological organism or cell sufficient to release at least some intracellular content.

"Microalgae" is a eukarytotic microbial organism that contains a chloroplast or plastid, and optionally that is capable of performing photosynthesis, or a prokaryotic microbial organism capable of performing photosynthesis. Microalgae include obligate photoautotrophs, which cannot metabolize a fixed carbon source as energy, as well as heterotrophs, which can live solely off of a fixed carbon source. Microalgae include unicellular organisms that separate from sister cells shortly after cell division, such as *Chlamydomonas*, as well as microbes such as, for example, *Volvox*, which is a simple multicellular photosynthetic microbe of two distinct cell types. Microalgae include cells such as *Chlorella, Dunaliella,* and *Prototheca*. Microalgae also include other microbial photosynthetic organisms that exhibit cell-cell adhesion, such as *Agmenellum, Anabaena,* and *Pyrobotrys*. Microalgae also include obligate heterotrophic microorganisms that have lost the ability to perform photosynthesis, such as certain dinoflagellate algae species and species of the genus *Prototheca*.

"Microorganism" and "microbe" are microscopic unicellular organisms.

"Naturally co-expressed" with reference to two proteins or genes means that the proteins or their genes are co-expressed naturally in a tissue or organism from which they are derived, e.g., because the genes encoding the two proteins are under the control of a common regulatory sequence or because they are expressed in response to the same stimulus.

"Overexpression of a Gene" refers to (i) genetically engineering a gene so that it has, relative to a wild-type gene, different control sequences that result in increased amounts of a gene product (RNA and, if the RNA is an mRNA, the protein encoded by the mRNA) in a cell; (ii) genetically engineering a cell so that it has, relative to a wild-type cell, more copies of a gene and increased amounts of the corresponding gene product; and/or (iii) genetically engineering the coding sequence of a gene to either increase the stability and/or activity of the gene product (i.e., if the increase the stability of an RNA gene product, increase translation of an mRNA gene product, and/or increase the level of enzymatic activity of a protein encoded by the mRNA gene product, i.e., by making the protein more stable or more active (which may also be referred to as "Overexpression of an Enzymatic Product"). An "Overexpressed Gene" is the product of overexpression of a gene by any of the foregoing methods. Overexpression of a gene thus results in "Increased Expression of a Gene".

"Promoter" is a nucleic acid control sequence that directs transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which may be located as much as several thousand base pairs from the start site of transcription.

"Prototheca cell" refers to any cell, strain, and species of microalgae of the genus *Prototheca*. Illustrative *Prototheca* cells and strains include, without limitation, those of any of the following species: *Prototheca wickerhamii, Prototheca stagnora, Prototheca portoricensis, Prototheca moriformis,* and *Prototheca zopfii*. In one important embodiment, a *Prototheca* cell is a cell or strain of *Prototheca moriformis*. More generally, microalgal cells, strains, and species that share greater than 75% sequence identity with the 23s rRNA of *Prototheca moriformis* or that listed in SEQ ID NO: 5.

"Recombinant" is a cell, nucleic acid, protein or vector that has been modified due to the introduction of an exogenous nucleic acid or the alteration of a native nucleic acid. Thus, e.g., recombinant cells express genes that are not found within the native (non-recombinant) form of the cell or express native genes differently than those genes are expressed by a non-recombinant cell. A "recombinant nucleic acid" is a nucleic acid originally formed in vitro, in general, by the manipulation of nucleic acid, e.g., using polymerases and endonucleases, or otherwise is in a form not normally found in nature, including an isolated form, i.e., wherein the nucleic acid is separated from at least one other component with which the native form of the nucleic acid naturally occurs. Recombinant nucleic acids may be produced, for example, to place two or more nucleic acids in operable linkage. Thus, an isolated nucleic acid or an expression vector formed in vitro by ligating DNA molecules that are not normally joined in nature, are both considered recombinant for the purposes of this invention. Once a recombinant nucleic acid is made and introduced into a host cell or organism, it may replicate using the in vivo cellular machinery of the host cell; however, such nucleic acids, once produced recombinantly, although subsequently replicated intracellularly, are still considered recombinant for purposes of this invention. Similarly, a "recombinant protein" is a protein made using recombinant techniques, i.e., through the expression of a recombinant nucleic acid.

The term "replacement" or "replace" or "replaced" when used in reference to modification of a gene sequence by another refers to the ablation or knockout of an endogenous gene by homologous recombination with an exogenous gene sequence containing suitable flanking regions.

"Inhibitory RNA" refers to RNA that inhibits gene expression Inhibitory RNA includes double-stranded interfering RNA. Inhibitory RNA includes long RNA hairpins, which, in some embodiments, are ~200 to 750 nucleotides in length, and comprise a coding sequence of the target gene of 50 to 650 nucleotides and its complementary sequence separated by sequence long enough (typically 25 to 200 nucleotides) to allow the coding sequence and its complementary to form a double-stranded sequence. RNAi also includes microRNAs, which are shorter than long RNA hairpins comprising typically only 19-22 nucleotides of the coding sequence of the target gene and its complement together with flanking sequences to engage the enzymes in the cell that mediate interference with gene expression by RNAi.

"Sonication" is a process of disrupting biological materials, such as a cell, by use of sound wave energy.

"Sucrose utilization gene" is a gene that, when expressed, aids the ability of a cell to utilize sucrose as an energy source. Proteins encoded by a sucrose utilization gene are referred to herein as "sucrose utilization enzymes" and include sucrose transporters, sucrose invertases, and hexokinases such as glucokinases and fructokinases.

"Up-regulation of an exogenous gene" refers to (i) genetically engineering a gene so that it has, relative to a wild-type gene, different control sequences that result in increased amounts of a gene product (RNA and, if the RNA is an mRNA, the protein encoded by the mRNA) in a cell; (ii) genetically engineering a cell so that it has, relative to a wild-type cell, more copies of a gene and increased amounts of the corresponding gene product; and/or (iii) genetically engineering the coding sequence of a gene to either increase the stability and/or activity of the gene product (i.e., if the increase the stability of an RNA gene product, increase translation of an mRNA gene product, and/or increase the level of enzymatic activity of a protein encoded by the mRNA gene product, i.e., by making the protein more stable or more active (which may also be referred to as "Up-regulation of an Enzymatic Product"). An "Up-regulated Gene" is the product of increased expression of a gene by any of the foregoing methods. Up-regulation of a gene thus results in "Increased Expression of a Gene".

Section II *Prototheca* Lipid Biosynthesis Pathway

In certain embodiments the present invention provides recombinant *Prototheca* cells that have been modified to alter the properties and/or proportions of lipids or fatty acids produced. The lipid biosynthesis pathway can further, or alternatively, be modified to alter the properties and/or proportions of various lipid molecules produced through enzymatic processing of lipids and intermediates in the lipid biosynthesis pathway. In various embodiments, the recombinant *Prototheca* cells of the invention have, relative to their untransformed counterparts, optimized lipid yield per unit volume and/or per unit time, carbon chain length (e.g., for renewable diesel production or for industrial chemicals applications requiring lipid feedstock), reduced number of double or triple bonds, optionally to zero, and increasing the hydrogen:carbon ratio of a particular species of lipid or of a population of distinct lipid. In other embodiments, the lipids have increased number of double bonds.

In particular embodiments, one or more key enzymes that control branch points of metabolism of fatty acids and glycerolipids have been up-regulated or down-regulated to improve lipid production. Up-regulation, or over-expression, of genes may be achieved, for example, by transforming cells with expression constructs in which a gene encoding the enzyme of interest is expressed, e.g., using a strong promoter and/or enhancer elements that increase transcription. Such constructs can include a selectable marker such that the transformants may be subjected to selection, which can result in amplification of the construct and an increase in the expression level of the encoded enzyme. Down-regulation, or attenuation, of genes may be achieved, for example, by transforming cells with expression cassettes that ablate, through homologous recombination, all or a portion of the chromosomally-encoded corresponding gene. Expression levels of lipid pathway enzymes can also optionally be reduced through the use of inhibitory RNA constructs. Optionally, endogenous lipid pathway genes may be modified to alter individually or in combination their enzymatic specificity, level of expression, or cellular localization. The expression cassettes used in up- or down-regulation can replicate by integration into chromosomal DNA of the host cell or as a freely replicating vector.

Genes and gene products of the *Prototheca morifomis* (UTEX 1435) lipid biosynthesis pathway are listed in Table 1 and detailed in the subsections A-K below. Where noted, different alleles of genes are provided. Typically, modest amino acid changes are seen between the two proteins, with alleles typically being 0-2% polymorphic in exons, and 4-7% polymorphic in introns.

TABLE 1

*Prototheca* Lipid Biosynthesis Genes

NAD-dependent glycerol-3-phosphate dehydrogenase (SEQ ID NO: 204, nucleotide, SEQ ID NO: 205, protein),
Fumarate hydratase (SEQ ID NO: 170, nucleotide, SEQ ID NO: 171, protein),
Pyruvate dehydrogenase, Alpha subunit (SEQ ID NO: 238, nucleotide, SEQ ID NO: 239, protein)
Pyruvate dehydrogenase, Beta subunit (SEQ ID NO: 240, nucleotide, SEQ ID NO: 241, protein)
Pyruvate Dehydrogenase, DLAT E2 subunit (SEQ ID NO: 242, nucleotide, SEQ ID NO: 243, protein)
Acetate kinase 1 (ACK1) allele 1 (SEQ ID NO: 107, nucleotide, SEQ ID NO: 108, protein),
Acetate kinase 1 (ACK1) allele 2 (SEQ ID NO: 109, nucleotide, SEQ ID NO: 110, protein),
Acetate kinase 2 (ACK2) (SEQ ID NO: 111, nucleotide, SEQ ID NO: 112, protein),
Lactate dehydrogenase (SEQ ID NO: 117, nucleotide, SEQ ID NO: 118, protein),
Phosphate acetyltransferase allele 1 (SEQ ID NO: 113, nucleotide, SEQ ID NO: 114, protein),
Phosphate acetyltransferase allele 2 (SEQ ID NO: 115, nucleotide, SEQ ID NO: 116, protein),
Lactate dehydrogenase (SEQ ID NO: 117, nucleotide, SEQ ID NO: 118, protein)
ACCase, Homomeric acetyl-CoA carboxylase, (SEQ ID NO: 262, nucleotide, SEQ ID NO: 263, protein)
Heteromeric acetyl-CoA carboxylase BC subunit allele 1 (SEQ ID NO: 104, nucleotide, SEQ ID NO: 93 protein),
Heteromeric acetyl-CoA carboxylase BC subunit allele 2 (SEQ ID NO: 103, nucleotide, SEQ ID NO: 94 protein),
Heteromeric acetyl-CoA carboxylase BCCP subunit allele 1 (SEQ ID NO: 101, nucleotide, SEQ ID NO: 95, protein),
Heteromeric acetyl-CoA carboxylase BCCP subunit allele 2 (SEQ ID NO: 102, nucleotide, SEQ ID NO: 96, protein),
Acetyl-CoA carboxylase alpha-CT subunit allele 1 (SEQ ID NO: 92, nucleotide, SEQ ID NO: 97, protein),
Acetyl-CoA carboxylase alpha-CT subunit allele 2 (SEQ ID NO: 99, nucleotide, SEQ ID NO: 98, protein),
Heteromeric acetyl-CoA carboxylase b-CT subunit, (SEQ ID NO: 222, nucleotide, SEQ ID NO: 223, protein)
Plastidial ACP allele 2 (SEQ ID NO: 90, protein)
Plastidial Acyl-Carrier Protein (ACP) allele 1 (SEQ ID NO: 206, nucleotide, SEQ ID NO: 207, protein)
Mitochondrial Acyl-Carrier Protein (ACP) allele 1 (SEQ ID NO: 64, nucleotide, SEQ ID NO: 65, protein)
Mitochondrial Acyl-Carrier Protein (ACP) allele 2 (SEQ ID NO: 194, nucleotide, SEQ ID NO: 195, protein)

TABLE 1-continued

*Prototheca* Lipid Biosynthesis Genes

Malonyl-CoA:ACP transacylase (MAT) (SEQ ID NO: 174, nucleotide, SEQ ID NO: 175 protein),
Ketoacyl-ACP synthase I allele 1 (KASI allele 1, SEQ ID NO: 69, nucleotide, SEQ ID NO: 70, protein),
Ketoacyl-ACP synthase I allele 2 (KASI allele 2, SEQ ID NO: 67, nucleotide, SEQ ID NO: 68, protein),
Ketoacyl-ACP synthase III (KASIII) (SEQ ID NO: 214, nucleotide, SEQ ID NO: 215, protein),
Ketoacyl-ACP reductase (KAR), SEQ ID NO: 258, nucleotide, SEQ ID NO: 259, protein)
Ketoacyl-CoA reductase (KCR) (SEQ ID NO: 184, nucleotide, SEQ ID NO: 185, protein),
3-Hydroxyacyl-ACP dehydrase (HD) (SEQ ID NO: 208, nucleotide, SEQ ID NO: 209, protein),
Enoyl-ACP reductase 1 version 1 (ENR1-1) (SEQ ID NO: 218 nucleotide, 220 protein)
Enoyl-ACP reductase 1 version 2 (ENR1-1) (SEQ ID NO: 219 nucleotide, 221 protein)
Trans-2-enoyl-CoA reductase (SEQ ID NO: 196, nucleotide, SEQ ID NO: 197, protein),
Stearoyl-ACP desaturase 1 allele 1 (SAD1 allele 1, SEQ ID NO: 87 nucleotide, SEQ ID NO: 88, protein),
Stearoyl-ACP desaturase 1 allele 2 (SAD1 allele 2, SEQ ID NO: 86 nucleotide, SEQ ID NO: 85, protein),
Fatty acyl-ACP thioesterease A (FATA) allele 1 (SEQ ID NO: 71, nucleotide, SEQ ID NO: 72, protein),
Glycerol-3-phosphate acyltransferase (GPAT), (SEQ ID NO: 224, nucleotide, SEQ ID NO: 225, protein),
Glycerol-3-phosphate acyltransferase (GPAT) (SEQ ID NO: 186, nucleotide, SEQ ID NO: 187, protein),
LPAAT-E, 1-Acyl-sn-glycerol-3-phosphate acyltransferase isoform E (SEQ ID NO: 81 nucleotide, SEQ ID NO: 82 protein),
LPAAT-A, 1-Acyl-sn-glycerol-3-phosphate acyltransferase isoform A (SEQ ID NO: 84 nucleotide, SEQ ID NO: 83 protein),
Posphatidic acid phosphatase (PAP), (SEQ ID NO: 226, nucleotide, SEQ ID NO: 227, protein)
Long-chain acyl-CoA ligase (SEQ ID NO: 198, nucleotide, SEQ ID NO: 199, protein),
DGAT1-1, Acyl-CoA:Diacylglycerol Acyltransferase 1, Alelle 1 (SEQ ID NO: 228, nucleotide, SEQ ID NO: 229, protein)
DGAT1-1, Acyl-CoA:Diacylglycerol Acyltransferase 1, Alelle 2 (SEQ ID NO: 230, nucleotide, SEQ ID NO: 231, protein)
DGAT2, Acyl-CoA:Diacylglycerol Acyltransferase 2 (SEQ ID NO: 232, nucleotide, SEQ ID NO: 233, protein)
Diacylglycerol kinase (DGK)/Sphingosine Kinase (Spik) (SEQ ID NO: 256, nucleotide, SEQ ID NO: 257, protein)
Choline kinase (SEQ ID NO: 236, nucleotide, SEQ ID NO: 237, protein)
Leafy cotyledon2 (LEC2) (SEQ ID NO: 254, nucleotide, SEQ ID NO: 255, protein)
ACLA, ATP:Citrate Lyase, Subunit A (SEQ ID NO: 250, nucleotide, SEQ ID NO: 251, protein)
ACLB, ATP:Citrate Lyase, Subunit B (SEQ ID NO: 252, nucleotide, SEQ ID NO: 253 protein)
Malic Enzyme (SEQ ID NO: 248, nucleotide, SEQ ID NO: 249, protein)
ACBP1, Acyl-CoA Binding Protein 1 (SEQ ID NO: 244, nucleotide, SEQ ID NO: 245, protein)
ACBP2, Acyl-CoA Binding Protein 2 (SEQ ID NO: 246, nucleotide, SEQ ID NO: 247, protein)
Phosphatidate cytidylyltransferase (SEQ ID NO: 176, nucleotide, SEQ ID NO: 177, protein),
Enoyl-CoA hydratase (SEQ ID NO: 192, nucleotide, SEQ ID NO: 193, protein),
Acyl-CoA oxidase (SEQ ID NO: 190, nucleotide, SEQ ID NO: 191, protein),
Lineolate FAD3 desaturase allele 1 (SEQ ID NO: 75, nucleotide, SEQ ID NO: 76, protein),
Lineolate FAD3 desaturase allele 2 (SEQ ID NO: 73, nucleotide, SEQ ID NO: 74, protein),
LS, lipoate synthase, (SEQ ID NO: 260, nucleotide, SEQ ID NO: 261, protein)
Glyoxysomal fatty acid beta-oxidation multifunctional protein (SEQ ID NO: 166, nucleotide, SEQ ID NO: 167, protein),
Monoglyceride lipase (SEQ ID NO: 188, nucleotide, SEQ ID NO: 189, protein),
Triacylglycerol lipase (SEQ ID NO: 168, nucleotide, SEQ ID NO: 169, protein),
Glycerophosphodiester phosphodiesterase (SEQ ID NO: 180, nucleotide, SEQ ID NO: 181, protein),
Membrane bound O-acyl transferase domain-containing protein (SEQ ID NO: 202, nucleotide, SEQ ID NO: 203, protein),
Lipid droplet protein 1, LDP1 (SEQ ID NO: 119, nucleotide, SEQ ID NO: 120, protein),
Succinate semialdehyde dehydrogenase (SEQ ID NO: 172, nucleotide, SEQ ID NO: 173, protein),
Sterol 14 desaturase (SEQ ID NO: 212, nucleotide, SEQ ID NO: 213, protein)
Nitrogen Response Regulator (NRR1) (SEQ ID NO: 264, SEQ ID NO: 265)
Monoacylglycerol Acyltransferase (MGAT1) (LPLAT-MGAT-like acyltransferase, DAGAT-domain containing) (also known in the art as 2-acylglycerol O-acyltransferase) (SEQ ID NO: 266, nucleotide, SEQ ID NO: 267, protein)
Cellulase/Endoglucanase (EG1) (SEQ ID NO: 268, nucleotide, SEQ ID NO: 269, protein)

A. Acetyl-CoA-Malony-CoA to Acyl-ACP

The early stages of fatty acid synthesis involve the conversion of a fixed carbon (e.g., glucose, sucrose, etc.) or other carbon sources into pyruvate. Next, the pyruvate dehydrogenase complex (PDH), comprising pyruvate dehydrogenase, dihydrolipoyl transacetylase, and dihydrolipoyl dehydrogenase, converts the three carbon metabolite pyruvate into the two carbon metabolite acetyl-CoA. The acetyl-CoA carboxylase (ACC) complex, utilizing bicarbonate as a substrate, generates the 3-carbon compound malonyl-CoA. Malonyl-CoA:ACP acyltransferase (MAT) then catalyzes the transfer of a malonyl group from malonyl-CoA to the acyl carrier protein (ACP), thereby generating malonyl-ACP. ACP is used as the acyl carrier for the various intermediate reactions in fatty acid biosynthesis. The metabolites acetyl-CoA and malonyl-CoA and the ACP protein are thus important starting points for fatty acid biosynthesis.

To genetically engineer a microbe for increased production of fatty acids and lipids, recombinant modifications may be made, either individually or in combination to obtain increased acetyl-CoA/malonyl-CoA/ACP production. For example, to increase malonyl-CoA production, an expression cassette may be generated and used to transform a microbe to overexpress polynucleotides encoding one or more components of the ACC enzyme complex under the control of a constitutive or regulated promoter. Additional examples of enzymes suitable for up-regulation according to embodiments of the invention include enzymes of the pyruvate dehydrogenase complex (examples, some from microalgae, include GenBank Accession Numbers NP_415392; AAA53047; Q1XDM1; and CAF05587). Up-regulation of pyruvate dehydrogenase can increase production of acetyl-CoA, and thereby increase fatty acid synthesis.

The acetyl-CoA carboxylase complex catalyzes the initial step in fatty acid synthesis. Accordingly, one or more enzymes comprising this complex may be up-regulated to increase production of fatty acids (examples, some from microalgae, include GenBank accession numbers BAA94752; AAA75528; AAA81471; YP_537052; YP_536879; NP_045833; and BAA57908). Enzymes of the ACCase complex may include the heteromeric ACCase BC subunit 1, the heteromeric ACCase BCC subunit, the heteromeric ACCase a-CT subunit, and the heteromeric ACCase b-CT subunit 1.

The ACC exists in two forms, a cytosolic, homomeric (single subunit) form and a heteromeric (multi-subunit) form in the plastid. Both types of ACC are found in *Prototheca* (UTEX 1435 strain). A plastid transit peptide was identified in the homomeric ACCase, indicating it may be localized to both the plastid and cytoplasm. In some embodiments, provided are sequences and related compositions and methods for expression of one or more a plastid-targeted homomeric ACC subunit(s). Plastid targeting can be achieved by attaching a leader plastid transit peptide selected from any of those provided herein, using the endogenous plastid transit peptide on the gene of interest itself, or obtained from any endogenous plastid-targeted gene in *Prototheca* containing a plastid transit peptide, or by using a heterologous plastid transit peptide. In other embodiments, provided are sequences and related compositions and methods for overexpression of one or more plastid-targeted, heteromeric ACC subunit(s). In some embodiments, the ACC overexpression decreases the ratio of C18:2 and C18:3 fatty acids by at least 5%, 10%, 15%, 20%, 30%, 40%, or 50%.

In some embodiments, ACC and one or more downstream lipid biosynthesis genes are simultaneously overexpressed. In one embodiment, provided are sequences, compositions, and methods for the simultaneous overexpression of ACC and DGAT. Starch levels, generally low in *Prototheca*, can be further reduced in favor of lipid biosynthesis by overexpressing ACC. In some embodiments, starch production is attenuated in concert with overexpression of one or more downstream lipid biosynthesis genes.

In other embodiments, provided are sequences, compositions, and methods for fatty acid production by up-regulation of polynucleotides encoding acyl carrier protein (ACP), which carries the growing acyl chains during fatty acid synthesis. Examples of ACPs, some from microalgae, include GenBank accession numbers A0T0F8; P51280; NP_849041; YP_874433 as well as SEQ ID NO: 207. Acyl carrier proteins can differ in subcellular localization (SEQ ID NOs: 63-65, SEQ ID NO: 195, and SEQ ID NO: 207). The sequences listed in SEQ ID NO: 194 and SEQ ID NO: 206 provide the coding sequences of the *Prototheca moriformis* amino acid sequence given in SEQ ID NO: 195 and SEQ ID NO: 207, respectively. In one embodiment of the present invention, it is advantageous to overexpress a first exogenous ACP and concomitantly down-regulate a different ACP.

Recombinant modifications may be made to increase the production of other intermediates in the lipid biosynthesis pathway. For example, to increase malonyl-ACP production, an expression cassette may be generated and used to transform a microbe to overexpress polynucleotides given in SEQ ID NO: 174 encoding *P. moriformis* malonyl-CoA:ACP transacylase (MAT) (SEQ ID NO: 175) active to transfer a malonyl group from malonyl-CoA to acyl carrier protein (ACP). This expression cassette may comprise a constitutive or inducible promoter active to drive expression of MAT.

In some embodiments, provide are sequences and methods for down regulation of Pyruvate Dehydrogenase Kinase (PDHK), a negative regulator of pyruvate dehydrogenase complex.

Enzymes that deplete pools of pyruvate or acetyl-CoA for the synthesis of metabolites other than fatty acids may compete with lipid biosynthesis pathway enzymes for precursor metabolites. Attenuation of these competitor enzymes may increase the production of fatty acids or lipids. To genetically engineer a microbe for increased production of fatty acids and lipids, recombinant modifications may be made, either individually or in combination to attenuate enzymes that compete for metabolite precursors. For example, to decrease the use of acetyl-CoA for acetate production, an expression cassette may be generated to ablate the gene or genes encoding *P. morifomis* (UTEX 1435) acetate kinase enzymes (SEQ ID NOs: 107-112). Attenuation of acetate kinase can also be achieved through the construction and use of expression cassettes comprising an antisense RNA under the control of a constitutive or regulated promoter. Additional examples of enzymes suitable for down-regulation according to embodiments of the present invention include *P. morifomis* (UTEX 1435) lactate dehydrogenase (SEQ ID NO: 117, nucleotide, SEQ ID NO: 118, protein), which synthesizes lactate from pyruvate or *P. morifomis* (UTEX 1435) phosphate acetyltransferase (PTA, SEQ ID NOs: 113-116), which catalyzes the conversion of acetyl-CoA to acetylphosphate, a step in the metabolism of acetate.

B. Acyl-ACP to Fatty Acid

A growing acyl-ACP chain is elongated in 2-carbon increments through a set of four enzymatic reactions involving condensation, a first reduction reaction, dehydration, and a second reduction reaction. These reactions are catalyzed by a condensing enzyme (β-ketoacyl-ACP synthase, KAS), a first reductase enzyme (β-ketoacyl-ACP reductase, KAR), adehydrase (β-hydroxyacyl-ACP dehydrase, HR) and a second reductase (enoyl-ACP reductase, ENR).

The initial condensation reaction between malonyl-ACP and acetyl-CoA to produce a 4-carbon compound is catalyzed by β-ketoacyl-ACP synthase (KAS) III. Successive 2-carbon additions to the elongating acyl-ACP chain, through C16:0, are catalyzed by KAS I. The enzyme KASII performs a 2-carbon extension of C16:0-ACP to C18:0-ACP. Depending on the desired properties of fatty acids to be produced, one or more KAS enzymes may be attenuated or over-expressed in the microbe. For example, to engineer a microbe for increased production of fatty acids with 18 or more carbon atoms, an expression cassette may be generated and used to transform a microbe to overexpress polynucleotides encoding a KASII enzyme under the control of a constitutive or inducible promoter. Examples of KASII enzymes suitable for use with embodiments of the present invention are the *Prototheca moriformis* KASII enzymes provided in SEQ ID NO: 106 (see Example 6) and SEQ ID NO: 211. The protein coding sequences for these enzymes are provided in SEQ ID NO: 105 and SEQ ID NO: 210. To genetically engineer a microbe for the increased production of short or mid chain fatty acids, an expression cassette may be generated and used to transform microbes to decrease the expression of KASII, such as through targeted knockdown or the use of inhibitory RNA. Optionally, the knockout or knockdown of KASII may be combined with use of polynucleotides to transform a microbe to overexpress polynucleotides encoding either a KASI or KASIII enzyme. An example of a KASIII enzyme suitable for use with embodiments of the present invention is the *P. moriformis* KASIII enzyme (provided in SEQ ID NO: 215), encoded by the polynucleotide sequence given in SEQ ID NO: 214. Examples of KASI enzymes suitable for use with embodiments of the present invention are the *P. moriformis* KASI enzymes alleles 1 and 2 provided in SEQ ID NO: 70 and 68, respectively. The protein coding sequence for these enzymes are provided in SEQ ID NO: 69 and SEQ ID NO: 67 respectively.

In an additional embodiment, a recombinant cell is engineered to overexpress a KASI and/or KASIII enzyme in a genetic background wherein KASII enzyme activity has not been attenuated. In still a further embodiment, recombinant polynucleotides are generated and used to transform a microbe to ablate or down-regulate a KASI enzyme to increase the production of fatty acids with greater than 16 carbons. Optionally, the knockout or knockdown of KASI may be combined with the use of polynucleotides to transform a microbe to overexpress polynucleotides encoding KASII.

To genetically engineer a microbe for increased production of specific fatty acids and lipids, recombinant modifications may be made, either individually or in combination to attenuate or overexpress enzymes that participate in fatty acid elongation. Such enzymes include β-ketoacyl-ACP reductase (KAR), β-hydroxyacyl-ACP dehydrase (HD), and enoyl-ACP reductase (ER). For example, an expression cassette may be generated and used to transform a microbe to overexpress polynucleotides encoding a KAR enzyme, a β-hydroxyacyl-ACP dehydrase, or an enoyl-ACP reductase under the control of a constitutive or inducible promoter. Alternatively, an expression cassette may be generated and used to transform a microbe to overexpress polynucleotides operable to knockout or attenuate the expression of a KAR enzyme, an HD enzyme, or an ER enzyme. An example of a KAR enzyme suitable for use with embodiments of the present invention is the *P. moriformis* KAR enzyme (provided in SEQ ID NO: 185), encoded by the polynucleotide sequence given in SEQ ID NO: 184. An example of an HD enzyme suitable for use with embodiments of the present invention is the *P. moriformis* HD enzyme (provided in SEQ ID NO: 209), encoded by the polynucleotide sequence given in SEQ ID NO: 208. Examples of ER enzymes suitable for use with embodiments of the present invention are *P. moriformis* ER (provided in SEQ ID NO: 201), encoded by the polynucleotide sequence given in SEQ ID NO: 200 and *P. moriformis* (UTEX 1435) trans-2-enoyl-CoA reductase (SEQ ID NO: 197, encoded by the polynucleotide sequence given in SEQ ID NO: 196). According to embodiments of the present invention, it may be advantageous to up-regulate or down-regulate a KAR, HD, or ER enzyme under specific culture conditions, for example during lipid production and/or in a genetic background of a microbe that has been engineered to alter additional lipid biosynthesis genes or gene products.

Fatty acyl-ACP thioesterase (TE) enzymes terminate elongation by hydrolyzing the acyl-ACP into free fatty acids and ACP. TEs may show specificity for acyl-ACPs of certain carbon lengths and degree of saturation or may be broad TEs, able to cleave acyl-ACP chains of varying length and level of saturation. The substrate specificity of TEs is an important contributor to establishing the chain length and degree of saturation of fatty acids. Depending on the desired length or degree of saturation of the fatty acid to be produced, one or more genes encoding acyl-ACP thioesterases may be attenuated or over-expressed in the microbe. For example, an endogenous fatty acyl-ACP thioesterase gene showing preference for C18:1-ACP (may be knocked out or reduced in expression while concomitantly a different TE, showing specificity for saturated C12 and C14-ACPs is overexpressed in the microbe, thereby altering the population of fatty acids in the microbe. An example an of acyl-ACP thioesterase suitable for use in embodiments of the present invention includes the *P. moriformis* acyl-ACP thioesterase FATA1 (provided in SEQ ID NO: 72), encoded by the polynucleotide sequence given in SEQ ID NO:71. Example 5, Example 34, and Example 36 describe the attenuation of a *P. moriformis* acyl-ACP thioesterase.

C. Unsaturated Fatty Acids and Fatty Acyl Chains

The introduction of carbon-carbon double bonds into a fatty acid, fatty acyl-CoA, or fatty acyl-ACP chains relies on the activity of desaturases. Desaturase enzymes may show specificity for the carbon chain length and degree of saturation of their substrates. Specific desaturases can convert saturated fatty acids or saturated fatty acyl-ACPs to unsaturated fatty acids or unsaturated fatty acyl-ACPs. Other desaturases enzymes may increase the number of carbon-carbon double bonds of unsaturated fatty acids.

Stearoyl-ACP desaturase (see, e.g., GenBank Accession numbers AAF15308; ABM45911; AAY86086, and SEQ ID Nos: 59-62), for example, catalyzes the conversion of stearoyl-ACP to oleoyl-ACP. Up-regulation of this gene can increase the proportion of monounsaturated fatty acids produced by a cell; whereas down-regulation can reduce the proportion of monounsaturates. For illustrative purposes, SADs are responsible for the synthesis of C18:1 fatty acids from C18:0 precursors.

Additional desaturases are the fatty acyl desaturases (FADs), including the phosphatidylglycerol desaturase (FAD4), the plastidial oleate desaturase (FAD6), the plastidial linoleate desaturase (FAD7/FAD8), endoplasmic reticulum oleate desaturase (FAD2), the endoplasmic reticulum linolate desaturase (FAD3), the delta 12 fatty acid desaturase (Δ12 FAD) and the delta 15 fatty acid desaturase (Δ15 FAD). These desaturases also provide modifications with respect to lipid saturation. For illustrative purposes, Δ12 fatty acid desaturases are responsible for the synthesis of C18:2 fatty acids from C18:1 precursors and Δ15 fatty acid desaturases are responsible for the synthesis of C18:3 fatty acids from C18:2 precursors.

Still additional desaturases, including the palmitate-specific monogalactosyldiacylglycerol desaturase (FAD5), the linoleoyl desaturase, ω-6 fatty acid desaturases, ω-3 fatty acid desaturases, and ω-6-oleate desaturases, provide modifications with respect to lipid saturation. The expression of one or more desaturases, such as ω-6 fatty acid desaturase, ω-3 fatty acid desaturase, or ω-6-oleate desaturase, may be controlled to alter the ratio of unsaturated to saturated fatty acids.

We have found Prototheca to have an extremely compact genome, with very compact promoter regions and extensive use of bi-directional promoters. For example, Prototheca has a single copy of FAD2 and FAD3 which are capable of multiple localization. FAD3 encodes two alternate start positions, one of which encodes a plastid transit peptide and the other of which does not. In addition FAD3 contains an ER retention signal in its 3' UTR which is shifted away from the COOH carboxy terminal in the plastid-targeted form, and shifted back in the ER-bound form. This allows the same gene to go to different sub-cellular locations depending on the needs of the organism.

Acyl-ACPs synthesized in the plastid are either used directly within that organelle to form lipids, including glycerolipids, or exported outside the plastid for synthesis of lipids including phospholipids, triacygylcerol, or waxes. Lipid biosynthesis genes may show specificity for activity in specific subcellular locations.

D. Fatty Acid to Fatty Acyl-CoA

Upon export from the plastid, fatty acids are re-esterified to CoA to form acyl-CoA via the catalytic action of acyl-CoA synthetase. Different acyl-CoA synthetase enzymes can differ in subcellular localization and show specificity for fatty acids of differing chain length. An example of an acyl-CoA synthetase is the enzyme long chain fatty acyl-CoA synthetase. Depending on the desired properties of the triacylglycerol to be produced, one or more genes encoding an acyl-CoA synthetase may be attenuated or over-expressed in the microbe.

E. Fatty Acyl-CoA to Triacylglycerol

Triacylglycerides may be formed through three sequential acyl-CoA-dependent acylations of a sn-glycerol-3-phosphate molecule. The first acylation, the rate-limiting step of glycerolipid synthesis, is catalyzed by glycerol-3-phosphate acyltransferase (GPAT) to produce lyso-phosphatidic acid. The second acylation step is catalyzed by the enzyme acyl-CoA: lyso-phosphatidic acid acyltransferase (LPAAT). Prior to the third acylation step, the enzyme phosphatidic acid phosphatase (PAP) (or lipins) carries out the removal of the phosphate group from phosphatidic acid to generate sn-1,2-diacylglycerol (DAG). The final acyl-CoA-dependent acylation is catalyzed by acyl-CoA:diacylglycerol acyltransferase (DGAT).

Microbes may be genetically engineered for increased production of lipids. For example, to increase the production of TAGs, an expression cassette may be generated and used to transform a microbe to polynucleotides operable to increase the expression of GPAT. This expression cassette may comprise a constitutive or inducible promoter active to drive expression of GPAT and may be utilized in the genetic background of a strain in which endogenous GPAT activity has been attenuated. An example of a GPAT suitable for use in an embodiment of the present invention is the P. moriformis GPAT, given here as SEQ ID NO: 187, encoded by the sequences given here in SEQ ID NO: 186.

Microbes may be genetically engineered for increased production of triacylglycerol molecules with desired properties. Certain acyltransferase enzymes, including GPATs, LPAATs, and DGATs may demonstrate specificity for a subcellular localization or substrate specificity for the length and degree of saturation of the acyl-CoA chain they transfer to the substituted glycerol backbone. Additionally, LPAAT and DGAT enzymes may show substrate specificity for the form of substituted glycerol to which they transfer an acyl-CoA. Depending on the desired properties of the triacylglyceridesto be produced, one or more genes encoding GPATs, LPAATs, DGATs, or other acyltranferases may be attenuated or overexpressed in the microbe. For example, to increase the production of TAGs with midchain fatty acids esterified at the sn-2 position, an expression cassette may be generated and used to transform a microbe to overexpress an LPAAT having specificity for transferring midchains. This expression cassette may comprise a constitutive or inducible promoter active to drive expression of LPAAT and may be utilized in the genetic background of a strain in which endogenous LPAAT activity has been attenuated. Examples of LPAATs suitable for use in embodiments of the present invention include the P. moriformis LPAAT E and LPAAT A, given in SEQ ID NO: 82 and SEQ ID NO: 83, encoded by the sequences given in SEQ ID NO: 81 and SEQ ID NO: 84, respectively.

In a similar fashion, to increase production of TAGs, an expression cassette may be generated and used to transform a microbe to overexpress polynucleotides encoding a DGAT, active to transfer a acyl-CoA to a DAG molecule. This expression cassette may comprise a constitutive or inducible promoter active to drive expression of DGAT2. An example of a DGAT suitable for use in the present invention is P. moriformis diacylglycerol acyltransferase type 2 (DGAT2) (SEQ ID NO: 183, encoded by the sequence given in SEQ ID NO: 182). According to the desired characteristics of the fatty acids or lipids to be produced by the recombinant microbe, it may be advantageous to couple up-regulation of a TE characterized by substrate specificity with one or more GPAT, LPAAT, or DGAT enzymes showing the same substrate specificity.

Additional acyltranferases suitable for use in embodiments of the present invention include P. moriformis membrane bound O-acyl transferase domain-containing protein (SEQ ID NO: 203, encoded by the nucleotide sequence provided in SEQ ID NO: 202), P. moriformis putative 1-acyl-sn-glycerol-3-phosphate acyltransferase (SEQ ID NO: 179, encoded by the nucleotide sequence provided in SEQ ID NO: 178), and P. moriformis acyl transferase (SEQ ID NO: 217, encoded by the nucleotide sequence provided in SEQ ID NO: 216). The Monoacylglycerol Acyltransferase (MGAT) gene, catalyzed the synthesis of diacyglycerol, and can generally also catalyze the final step in triacylglycerol biosynthesis. Hence, upregulation of the MGAT gene provided in this invention may be desirable.

Alternate lipid pathway enzymes can generate triacylglyceride molecules through a route separate from that above. Enzymes of the fatty acyl-CoA-independent triacylglycerol pathway transfer fatty acyl groups between phosphatidylcholine (PC) moieties employing acyl-lysophosphatidylcholine acyl transferases that may exhibit selective substrate specificity, ultimately transferring them to diacylglycerol.

F. Additional Lipid Molecules

In addition to their incorporation into DAGs and TAGs, fatty acids or fatty acyl molecules may be incorporated into a range of lipid molecules including but not limited to phospholipids, phosphatidylcholine (PC), phosphatidylserine (PS), phosphatidylinositol (PI), sphingolipids (SL), monogalactosyldiacylglycerol, digalactosyldiacylglycerol, liponucleotides, and wax esters. Enzymes that synthesize molecules of PC, PS, PI, SL, wax esters, liponucleotides, or the galactolipids monogalactosyldiacylglycerol (MGDG) or digalactosyldiacylglycerol (DGDG) may compete with enzymes that lead to or ultimately synthesize DAGs and TAGs for substrates including fatty acids or fatty acyl molecules. Genes encoding proteins involved in the synthesis, utilization, or degradation of PC, PS, PI, SL, monogalactosyldiacylglycerol, digalactosyldiacylglycerol, or wax esters may include diacylglycerol cholinephosphotransferase (DAG-CPT), cytidine diphosphate diacylglycerol synthase (CTP-DAG synthase), phosphatidylinositol synthase (PI synthase), choline kinase (CK), phosphatidylinositol-3-kinase (PI3-Kinase), phosphatidylinositol-4-kinase (PI4-Kinase), diacyerolglycerol kinase (DGK), phosphatidylglycerol-3-phosphate phosphatase (PGPP), cholinephosphate cytidylyltransferase (CPCT), phosphatidate cytidylyltransferase, phosphatidylserine decarboxylase (PSD), phospholipase C(PliC), phospholipase D (PliD), sphingolipid desaturase (SD), monogalactosyldiacylglycerol synthase (MGDG synthase), digalactosyldiacylglycerol synthase (DGDG synthase), ketoacyl-CoA synthase (KCS), 3-ketoacyl reductase (KR), and wax synthase (WS). Depending on the desired properties of the fatty acids or lipid molecules to be produced, one or more genes encoding enzymes that utilize fatty acids or fatty acyl molecules as substrates to produce lipid molecules may be attenuated or over-expressed in the microbe.

In one embodiment, provided are sequences, compositions, and methods for inhibition of DGK, which converts DAG to PA. For example, DGK can be inhibited through use of RNAi, hairpin constructs, or double or single knockouts. In other embodiments, provided are sequences, compositions, and methods for overexpression of epsilon subtype (DGKe). In some aspects, overexpression of DGKe results in selective removal of DAGs with certain acyl groups such as C20:4.

To engineer a microbe for the increased production of triglycerides, it may be advantageous to attenuate enzymes that support phospholipid synthesis. For example, to decrease production of the phospholipid cytidine diphosphate (CDP)-diacylglycerol, an expression cassette may be generated and used to transform a microbe to attenuate phosphatidate cytidylyltransferase, which catalyzes condensation of phosphatidic acid and cytidine triphosphate to produce to CDP-diacylglycerol. An example of a phosphatidate cytidylyltransferase suitable for use in an embodiment of the present invention is *P. moriformis* phosphatidate cytidylyltransferase (SEQ ID NO: 177), encoded by the polynucleotide sequence given by SEQ ID NO: 176. This expression cassette may comprise a constitutive or inducible promoter active to drive down-regulate expression of the phosphatidate cytidylyltransferase.

Further, additional lipid moieties other than triacylglycerides may utilize derivations of phosphorylated glycerol as a backbone. Enzymes such as phosphatidylglycerophosphate synthase (PGP Synthase), involved in the synthesis of phopholipids may compete with enzymes that provide for triacylglycerols for substrates including phosphorylated forms of glycerol. Depending on the desired properties of the lipid molecule to be produced, one or more genes encoding phosphatidylglycerophosphate synthase may be attenuated or over-expressed in the microbe. Lipoate Synthase (LS), also called Lipoyl Synthase or Lipoic Acid Synthase, is generally localized to the mitochondria and utilized in the synthesis of lipoic acid. Lipoic acid is an important co-factor and antioxidant.

G. Fatty Acid Degradation

To genetically engineer a microbe for increased production of specific fatty acids and lipids, recombinant modifications may be made, either individually or in combination, to decrease the degradation of fatty acids and lipids. As proteins such as acyl-CoA oxidase, 3-ketoacyl-CoA thiolase, acyl-CoA dehydrogenase, glyoxysomal fatty acid beta-oxidation multifunctional protein, and enoyl-CoA hydratase are involved in the degradation of fatty acids, these and other proteins may be attenuated in the microbe to slow or prevent fatty acid degradation. For example, to engineer a microbe to decrease fatty acid degradation, an expression cassette may be generated and used to transform a microbe to down-regulate one or more of acyl-CoA oxidase, enoyl-CoA hydratase, and glyoxysomal fatty acid beta-oxidation multifunctional protein, either through a knockout or knockdown approach. An example of an acyl-CoA oxidase enzyme suitable for use with embodiments of the present invention is the *Prototheca moriformis* acyl-CoA oxidase (provided in SEQ ID NO: 191), encoded by the polynucleotide sequence given in SEQ ID NO: 190). An example of an enoyl-CoA hydratase suitable for use with embodiments of the present invention is the *Prototheca moriformis* enoyl-CoA hydratase (provided in SEQ ID NO: 193), encoded by the polynucleotide sequence given in SEQ ID NO: 192. An example of a glyoxysomal fatty acid beta-oxidation multifunctional protein suitable for use in embodiments of the present invention is the *P. moriformis* (UTEX 1435) glyoxysomal fatty acid beta-oxidation multifunctional protein, presented in SEQ ID NO: 167, encoded by the polynucleotide sequence given in SEQ ID NO: 166. According to the desired chain length and degree of saturation of the fatty acids to be produced by the recombinant microbe, it may be advantageous to down-regulate fatty acid or lipid degradation enzymes in the genetic background of a microbe that has been engineered to alter additional lipid pathway genes or gene products.

Long-chain acyl-CoA synthetases (also known in the art as long-chain acyl-CoA ligases) convert free fatty acids into acyl-CoA thioesters. These acyl-CoA thioesters may then be degraded by enzymes involved in fatty β-oxidation. To engineer a microbe for decreased fatty acid degradation, an expression cassette may be generated and used to transform a microbe to down-regulate long-chain acyl-CoA synthetase, either through a knockout or knockdown approach. An example of long-chain acyl-CoA synthetase suitable for use in an embodiment of the present invention is the *P. moriformis* (UTEX 1435), long-chain acyl-CoA synthetase presented in SEQ ID NO: 199, encoded by the polynucleotide sequence given in SEQ ID NO: 198. According to the desired chain length and degree of saturation of the fatty acids to be produced by the recombinant microbe, it may be advantageous to down-regulate long-chain acyl-CoA synthetase in the genetic background of a microbe that has been engineered to alter additional lipid pathway genes or gene products.

H. Monoglyceride, Triglyceride, and Lipid Degradation

A strategy to increase the recombinant microbial production of triglycerides is to prevent or reduce the enzymatic degradation of these molecules. Enzymes such as monoglyceride lipase and triacylglycerol lipase that hydrolyze triglycerides to fatty acids and glycerol are examples of proteins that may be attenuated in a microbe to slow or prevent degradation of triglycerides. For example, to engineer a microbe to decrease triglyceride degradation an expression cassette may be generated and used to transform a microbe to down-regulate monoglyceride lipase or triacylglycerol lipase, either through a knockout or knockdown approach. An example of a monoglyceride lipase suitable for use in embodiments of the present invention is the *P. moriformis* (UTEX 1435) monoglyceride lipase presented in SEQ ID NO: 189, encoded by the polynucleotide sequence given in SEQ ID NO: 188. An example of a triacylglycerol lipase suitable for use in embodiments of the present invention is the *P. moriformis* (UTEX 1435) triacylglycerol lipase presented in SEQ ID NO: 169, encoded by the polynucleotide sequence given in SEQ ID NO: 168. According to embodiments of the present invention, it may be advantageous to attenuate one or more lipases under specific culture conditions, for example during lipid production.

I. Global Regulators

Furthermore, up- and/or down-regulation of genes may be applied to global regulators controlling the expression of the genes of the lipid biosynthetic pathway. Accordingly, one or more global regulators of lipid synthesis may be up- or down-regulated, as appropriate, to inhibit or enhance, respectively, the expression of a plurality of fatty acid synthetic genes and, ultimately, to increase lipid production. Examples include sterol regulatory element binding proteins (SREBPs), such as SREBP-1a and SREBP-1c (for examples see GenBank accession numbers NP_035610 and Q9WTN3). In one embodiment, a global regulator such as the endogenous LEC2 homolog, may be upregulated to increase lipid production. Decoupling or alteration of nitrogen sensing from the process of lipid biosynthesis may also be of value (Boyle et al, J. Biol. Chem., May 4, 2012). Also presented in this invention is a Nitrogen Response Regulator, NRR1, a Squamosa Binding protein. In some instance it may be desirable, for example, to increase the response to nitrogen starvation by enhancing expression of NRR1.

J. Lipid Droplet Proteins

Eukaryotic cells store triacylglycerol molecules in distinct organelles, often called lipid droplets. Proteins associated with lipid droplet proteins, such as lipid droplet protein 1 (LDP1, SEQ ID NOs: 119-120), are crucial to lipid droplet structure, formation, size, and number. In some instances, attenuation of lipid droplet proteins results in increases in lipid droplet size. In other instances, overexpression of mutated sequences of lipid droplet proteins results in increased lipid droplet size and number. To genetically engineer a microbe for the production of fatty acids and lipids, recombinant modifications may be made, either individually or in combination to alter the expression of lipid droplet proteins. For example, an expression cassette may be generated to attenuate or ablate the gene or gene products encoding lipid droplet proteins (SEQ ID NOs: 119-120). Attenuation of gene products through the use of RNAi, RNA hairpin, or other antisense-mediated strategy may be coupled to an inducible or constitutive promoter. In an additional embodiment, an expression cassette may be generated to overexpress one or more lipid droplet proteins. Overexpression of lipid droplet proteins may be driven by constitutive or inducible promoters. *P. moriformis* (UTEX 1435) does not contain oleosins, the plant equivalent of algal Lipid Droplet Proteins (LDPs). Instead, algal Lipid Droplet Proteins, such as the LDP1 presented here, are suitable for overexpression to alter lipid droplet morphology.

K. Altering Carbon Metabolism

Numerous enzymatic pathways are involved in metabolizing sugars and metabolites into intermediates suitable for use in fatty acid or lipid synthesis or for other cellular pathways. In one embodiment of the present invention, it is advantageous to alter the regulation or activity of enzymes that contribute to production of metabolites involved in lipid synthesis or that utilize the intermediates or metabolites of lipid synthesis for pathways other than the fatty acid and lipid pathways. The Kreb's cycle is such a metabolic pathway that consumes acetyl-CoA to ultimately produce carbon dioxide. Enzymatic participants of the Kreb's Cycle include fumarate hydratase (also known in the art as fumarase). To engineer a microbe for the increased production of specific fatty acids or lipids, an expression cassette may be generated and used to transform a microbe to attenuate fumarate hydratase, either through a knockout or knockdown approach. An example of a fumarate hydratase suitable for use in embodiments of the present invention is the *P. moriformis* (UTEX 1435) fumarate hydratase presented in SEQ ID NO: 171, encoded by the polynucleotide sequence given in SEQ ID NO: 170. According to embodiments of the present invention, it may be advantageous to attenuate fumarate hydratase under specific culture conditions, for example during lipid production.

An additional example of an enzyme involved in carbon metabolism is NAD-dependent glycerol-3-phosphate dehydrogenase that reversibly converts sn-glycerol 3-phosphate to dihydrohyxacetone phosphate, (also known in the art as glycerone phosphate). To increase the level of the triacylglycerol backbone precursor molecule, the sn-glycerol 3-phosphate metabolite, an expression cassette may be generated and used to transform a microbe to enhance expression of NAD-dependent glycerol-3-phosphate dehydrogenase. An example of an NAD-dependent glycerol-3-phosphate dehydrogenase suitable for use in embodiments of the present invention is the *P. moriformis* (UTEX 1435) NAD-dependent glycerol-3-phosphate dehydrogenase presented in SEQ ID NO: 205, encoded by the polynucleotide sequence given in SEQ ID NO: 204. According to embodiments of the present invention, it may be advantageous to attenuate NAD-dependent glycerol-3-phosphate dehydrogenase under specific culture conditions, for example during lipid production. In some embodiments, it may be advantageous to combine the expression of several pathway enzymes for triacylglycerol production, for example the PAP, G3PDH, GPAT, LPPAT, and DGAT combination.

Other proteins, such as glycerophosphodiester phosphodiesterase, synthesize intermediates of the lipid pathway. Glycerophosphodiester phosphodiesterase hydrolyses a glycerophosphodiester to form sn-glycerol 3-phosphate, which may be used in lipid synthesis. To engineer a microbe for increased production of lipids, an expression cassette may be generated and used to transform a microbe to overexpress polynucleotides encoding glycerophosphodiester phosphodiesterase. An example of a glycerophosphodiester phosphodiesterase suitable for use in embodiments of the present invention is *P. moriformis* (UTEX 1435) glycerophosphodiester phosphodiesterase (SEQ ID NO: 181), encoded by the polynucleotide sequence given in SEQ ID NO: 180. Celluases, such as endoglucanase, are useful for breaking down cellulosic compounds into sugar utilizable by the cell. Provided is an endogenous endoglucanase that may potentially find uses in secretion to break down cellulosic material, or as a mechanism for loosening cell walls to allow for enhanced lipid droplet formation.

Section III. Cultivation

In certain embodiments, the present invention generally relates to cultivation of microbes, e.g., oleaginous microbes, such as microalgae, including *Chlorella* and *Prototheca* species and strains, and yeast, fungi, plant, and bacteria species and strains, for the production of microbial oil (lipids). In particular embodiments, the microbes are recombinant microbes. The following discussion focuses on *Prototheca* as an illustrative species. For the convenience of the reader, this section is subdivided into subsections. Subsection 1 describes *Prototheca* species and strains and how to identify new *Prototheca* species and strains and related microalgae by genomic DNA comparison. Subsection 2 describes bioreactors useful for cultivation. Subsection 3 describes media for cultivation. Subsection 4 describes oil production in accordance with illustrative cultivation methods of the invention.

1. Prototheca Species and Strains

*Prototheca* is a remarkable microorganism for use in the production of lipid, because it can produce high levels of lipid, particularly lipid suitable for fuel production. The lipid produced by *Prototheca* has hydrocarbon chains of shorter chain length and a higher degree of saturation than that produced by other microalgae. Moreover, *Prototheca* lipid is generally free of pigment (low to undetectable levels of chlorophyll and certain carotenoids) and in any event contains much less pigment than lipid from other microalgae. Moreover, recombinant *Prototheca* cells provided by the invention may be used to produce lipid in greater yield and efficiency, and with reduced cost, relative to the production of lipid from other microorganisms. Illustrative *Prototheca* strains for use in the methods of the invention include *Prototheca wickerhamii, Prototheca stagnora* (including UTEX 327), *Prototheca portoricensis, Prototheca moriformis* (including UTEX strains 1441, 1435), and *Prototheca zopfii*. In addition, this microalgae grows heterotrophically and may be genetically engineered. Species of the genus *Prototheca* are obligate heterotrophs.

Species of *Prototheca* for use in the invention may be identified by amplification of certain target regions of the genome. For example, identification of a specific *Prototheca* species or strain may be achieved through amplification and sequencing of nuclear and/or chloroplast DNA using primers and methodology using any region of the genome, for example using the methods described in Wu et al., *Bot. Bull. Acad. Sin*. (2001) 42:115-121 Identification of *Chlorella* spp. isolates using ribosomal DNA sequences. Well established methods of phylogenetic analysis, such as amplification and sequencing of ribosomal internal transcribed spacer (ITS1 and ITS2 rDNA), 23S rRNA, 18S rRNA, and other conserved genomic regions may be used by those skilled in the art to identify species of not only *Prototheca*, but other hydrocarbon and lipid producing organisms with similar lipid profiles and production capability. For examples of methods of identification and classification of algae also see for example *Genetics*, 2005 August; 170(4):1601-10 and *RNA*, 2005 April; 11(4):361-4.

Thus, genomic DNA comparison may be used to identify suitable species of microalgae to be used in the present invention. Regions of conserved genomic DNA, such as but not limited to DNA encoding for 23S rRNA, may be amplified from microalgal species and compared to consensus sequences in order to screen for microalgal species that are taxonomically related to the preferred microalgae used in the present invention. Examples of such DNA sequence comparison for species within the *Prototheca* genus are shown below. Genomic DNA comparison can also be useful to identify microalgal species that have been misidentified in a strain collection. Often a strain collection will identify species of microalgae based on phenotypic and morphological characteristics. The use of these characteristics may lead to miscategorization of the species or the genus of a microalgae. The use of genomic DNA comparison may be a better method of categorizing microalgae species based on their phylogenetic relationship.

Microalgae for use in the present invention typically have genomic DNA sequences encoding for 23S rRNA that have at least 99%, least 95%, at least 90%, or at least 85% nucleotide identity to at least one of the sequences listed in SEQ ID NOs: 1-9.

For sequence comparison to determine percent nucleotide or amino acid identity, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison may be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., supra).

Another example algorithm that is suitable for determining percent sequence identity and sequence similarity is the BLAST algorithm, which is described in Altschul et al., *J. Mol. Biol.* 215:403-410 (1990). Software for performing BLAST analyses is publicly available through the National Center for Biotechnology Information (at the web address www.ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra.). These initial neighborhood word hits act as seeds for initiating searches to find longer HSPs containing them. The word hits are then extended in both directions along each sequence for as far as the cumulative alignment score may be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below due to the accumulation of one or more negative-scoring residue alignments; or the end of either sequence is reached. For identifying whether a nucleic acid or polypeptide is within the scope of the invention, the default parameters of the BLAST programs are suitable. The BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix. The TBLASTN program (using protein sequence for nucleotide sequence) uses as defaults a word length (W) of 3, an expectation (E) of 10, and a BLOSUM 62 scoring matrix. (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

It is understood that the peptide and protein sequences provided herein can have conservative or non-essential amino acid substitutions that do not have a substantial effect on the function of the peptide. Conservative amino acid substitutions include replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100 or more amino acid substitutions, additions, insertions, or deletions.

Other considerations affecting the selection of microorganisms for use in the invention include, in addition to production of suitable lipids or hydrocarbons for production of oils, fuels, and oleochemicals: (1) high lipid content as a percentage of cell weight; (2) ease of growth; (3) ease of genetic engineering; and (4) ease of biomass processing. In particular embodiments, the wild-type or genetically engineered microorganism yields cells that are at least 40%, at least 45%, at least 50%, at least 55%, at least 60%, at least 65%, or at least 70% or more lipid. Preferred organisms grow heterotrophically (on sugars in the absence of light).

Examples of algae that may be used to practice the present invention include, but are not limited to the following algae: *Prototheca wickerhamii, Prototheca stagnora, Prototheca portoricensis, Prototheca moriformis, Prototheca zopfii*.

2. Bioreactor

Microorganisms are cultured both for purposes of conducting genetic manipulations and for production of hydrocarbons (e.g., lipids, fatty acids, aldehydes, alcohols, and alkanes). The former type of culture is conducted on a small scale and initially, at least, under conditions in which the starting microorganism can grow. Culture for purposes of hydrocarbon production is usually conducted on a large scale (e.g., 10,000 L, 40,000 L, 100,000 L or larger bioreactors) in a bioreactor. Microalgae, including *Prototheca* species are typically cultured in the methods of the invention in liquid media within a bioreactor. Typically, the bioreactor does not allow light to enter.

The bioreactor or fermentor is used to culture microalgal cells through the various phases of their physiological cycle. Bioreactors offer many advantages for use in heterotrophic growth and propagation methods. To produce biomass for use in food, microalgae are preferably fermented in large quantities in liquid, such as in suspension cultures as an example. Bioreactors such as steel fermentors can accommodate very large culture volumes (40,000 liter and greater capacity bioreactors are used in various embodiments of the invention). Bioreactors also typically allow for the control of culture conditions such as temperature, pH, oxygen tension, and carbon dioxide levels. For example, bioreactors are typically configurable, for example, using ports attached to tubing, to allow gaseous components, like oxygen or nitrogen, to be bubbled through a liquid culture. Other culture parameters, such as the pH of the culture media, the identity and concentration of trace elements, and other media constituents can also be more readily manipulated using a bioreactor.

Bioreactors may be configured to flow culture media though the bioreactor throughout the time period during which the microalgae reproduce and increase in number. In some embodiments, for example, media may be infused into the bioreactor after inoculation but before the cells reach a desired density. In other instances, a bioreactor is filled with culture media at the beginning of a culture, and no more culture media is infused after the culture is inoculated. In other words, the microalgal biomass is cultured in an aqueous medium for a period of time during which the microalgae reproduce and increase in number; however, quantities of aqueous culture medium are not flowed through the bioreactor throughout the time period. Thus in some embodiments, aqueous culture medium is not flowed through the bioreactor after inoculation.

Bioreactors equipped with devices such as spinning blades and impellers, rocking mechanisms, stir bars, or means for pressurized gas infusion may be used to subject microalgal cultures to mixing. Mixing may be continuous or intermittent. For example, in some embodiments, a turbulent flow regime of gas entry and media entry is not maintained for reproduction of microalgae until a desired increase in number of said microalgae has been achieved.

Bioreactor ports may be used to introduce, or extract, gases, solids, semisolids, and liquids, into the bioreactor chamber containing the microalgae. While many bioreactors have more than one port (for example, one for media entry, and another for sampling), it is not necessary that only one substance enter or leave a port. For example, a port may be used to flow culture media into the bioreactor and later used for sampling, gas entry, gas exit, or other purposes. Preferably, a sampling port may be used repeatedly without altering compromising the axenic nature of the culture. A sampling port may be configured with a valve or other device that allows the flow of sample to be stopped and started or to provide a means of continuous sampling. Bioreactors typically have at least one port that allows inoculation of a culture, and such a port can also be used for other purposes such as media or gas entry.

Bioreactors ports allow the gas content of the culture of microalgae to be manipulated. To illustrate, part of the volume of a bioreactor may be gas rather than liquid, and the gas inlets of the bioreactor to allow pumping of gases into the bioreactor. Gases that may be beneficially pumped into a bioreactor include air, air/$CO_2$ mixtures, noble gases, such as argon, and other gases. Bioreactors are typically equipped to enable the user to control the rate of entry of a gas into the bioreactor. As noted above, increasing gas flow into a bioreactor may be used to increase mixing of the culture.

Increased gas flow affects the turbidity of the culture as well. Turbulence may be achieved by placing a gas entry port below the level of the aqueous culture media so that gas entering the bioreactor bubbles to the surface of the culture. One or more gas exit ports allow gas to escape, thereby preventing pressure buildup in the bioreactor. Preferably a gas exit port leads to a "one-way" valve that prevents contaminating microorganisms from entering the bioreactor.

3. Media

Microalgal culture media typically contains components such as a fixed nitrogen source, a fixed carbon source, trace elements, optionally a buffer for pH maintenance, and phosphate (typically provided as a phosphate salt). Other components can include salts such as sodium chloride, particularly for seawater microalgae. Nitrogen sources include organic and inorganic nitrogen sources, including, for example, without limitation, molecular nitrogen, nitrate, nitrate salts, ammonia (pure or in salt form, such as, $(NH_4)_2SO_4$ and $NH_4OH$), protein, soybean meal, cornsteep liquor, and yeast extract. Examples of trace elements include zinc, boron, cobalt, copper, manganese, and molybdenum in, for example, the respective forms of $ZnCl_2$, $H_3BO_3$, $CoCl_2.6H_2O$, $CuCl_2.2H_2O$, $MnCl_2.4H_2O$ and $(NH_4)_6Mo_7O_{24}.4H_2O$.

Microorganisms useful in accordance with the methods of the present invention are found in various locations and environments throughout the world. As a consequence of their isolation from other species and their resulting evolutionary divergence, the particular growth medium for optimal growth and generation of lipid and/or hydrocarbon constituents may be difficult to predict. In some cases, certain strains of microorganisms may be unable to grow on a particular growth medium because of the presence of some inhibitory component or the absence of some essential nutritional requirement required by the particular strain of microorganism.

Solid and liquid growth media are generally available from a wide variety of sources, and instructions for the preparation of particular media that is suitable for a wide variety of strains of microorganisms may be found, for example, online at http://www.utex.org/, a site maintained by the University of Texas at Austin, 1 University Station A6700, Austin, Tex., 78712-0183, for its culture collection of algae (UTEX). For example, various fresh water and salt water media include those described in PCT Pub. No. 2008/151149, incorporated herein by reference.

In a particular example, Proteose Medium is suitable for axenic cultures, and a 1 L volume of the medium (pH ~6.8) may be prepared by addition of 1 g of proteose peptone to 1 liter of Bristol Medium. Bristol medium comprises 2.94 mM $NaNO_3$, 0.17 mM $CaCl_2.2H_2O$, 0.3 mM $MgSO_4.7H_2O$, 0.43 mM, 1.29 mM $KH_2PO_4$, and 1.43 mM NaCl in an aqueous solution. For 1.5% agar medium, 15 g of agar may be added to 1 L of the solution. The solution is covered and autoclaved, and then stored at a refrigerated temperature prior to use. Another example is the *Prototheca* isolation medium (PIM), which comprises 10 g/L potassium hydrogen phthalate (KHP), 0.9 g/L sodium hydroxide, 0.1 g/L magnesium sulfate, 0.2 g/L potassium hydrogen phosphate, 0.3 g/L ammonium chloride, 10 g/L glucose 0.001 g/L thiamine hydrochloride, 20 g/L agar, 0.25 g/L 5-fluorocytosine, at a pH in the range of 5.0 to 5.2 (see Pore, 1973, App. Microbiology, 26: 648-649). Other suitable media for use with the methods of the invention may be readily identified by consulting the URL identified above, or by consulting other organizations that maintain cultures of microorganisms, such as SAG, CCAP, or CCALA. SAG refers to the Culture Collection of Algae at the University of Göttingen (Göttingen, Germany), CCAP refers to the culture collection of algae and protozoa managed by the Scottish Association for Marine Science (Scotland, United Kingdom), and CCALA refers to the culture collection of algal laboratory at the Institute of Botany (Třeboň, Czech Republic). Additionally, U.S. Pat. No. 5,900,370 describes media formulations and conditions suitable for heterotrophic fermentation of *Prototheca* species.

For oil production, selection of a fixed carbon source is important, as the cost of the fixed carbon source must be sufficiently low to make oil production economical. Thus, while suitable carbon sources include, for example, acetate, floridoside, fructose, galactose, glucuronic acid, glucose, glycerol, lactose, mannose, N-acetylglucosamine, rhamnose, sucrose, and/or xylose, selection of feedstocks containing those compounds is an important aspect of the methods of the invention. Suitable feedstocks useful in accordance with the methods of the invention include, for example, black liquor, corn starch, depolymerized cellulosic material, milk whey, molasses, potato, sorghum, sucrose, sugar beet, sugar cane, rice, and wheat. Carbon sources can also be provided as a mixture, such as a mixture of sucrose and depolymerized sugar beet pulp. The one or more carbon source(s) may be supplied at a concentration of at least about 50 μM, at least about 100 μM, at least about 500 μM, at least about 5 mM, at least about 50 mM, and at least about 500 mM, of one or more exogenously provided fixed carbon source(s). Highly concentrated carbon sources as feedstock for fermentation are preferred. For example, in some embodiments glucose levels of at least 300 g/L, at least 400 g/L, at least 500 g/L, or at least 600 g/L or more of glucose level of the feedstock prior to the cultivation step, is added to a fed batch cultivation, in which the highly concentrated fixed carbon source is fed to the cells over time as the cells grow and accumulate lipid. In other embodiments, sucrose levels of at least 500 g/L, at least 600 g/L, at least 700 g/L, at least 800 g/L or more of sucrose prior to the cultivation is added to a fed batch cultivation, in which the highly concentrated fixed carbon source is fed to the cells over time as the cells grow and accumulate lipid. Non-limiting examples of highly concentrated fixed carbon source such as sucrose include thick cane juice, sugar cane juice, sugar beet juice and molasses. Carbon sources of particular interest for purposes of the present invention include cellulose (in a depolymerized form), glycerol, sucrose, and sorghum, each of which is discussed in more detail below.

In accordance with the present invention, microorganisms may be cultured using depolymerized cellulosic biomass as a feedstock. Cellulosic biomass (e.g., stover, such as corn stover) is inexpensive and readily available; however, attempts to use this material as a feedstock for yeast have failed. In particular, such feedstocks have been found to be inhibitory to yeast growth, and yeast cannot use the 5-carbon sugars produced from cellulosic materials (e.g., xylose from hemi-cellulose). By contrast, microalgae can grow on processed cellulosic material. Cellulosic materials generally include about 40-60% cellulose; about 20-40% hemicellulose; and 10-30% lignin.

Suitable cellulosic materials include residues from herbaceous and woody energy crops, as well as agricultural crops, i.e., the plant parts, primarily stalks and leaves, not removed from the fields with the primary food or fiber product. Examples include agricultural wastes such as sugarcane bagasse, rice hulls, corn fiber (including stalks, leaves, husks, and cobs), wheat straw, rice straw, sugar beet pulp, citrus pulp, citrus peels; forestry wastes such as hardwood and softwood thinnings, and hardwood and softwood residues from timber operations; wood wastes such as saw mill wastes (wood chips, sawdust) and pulp mill waste; urban wastes such as paper fractions of municipal solid waste, urban wood waste and urban green waste such as municipal grass clippings; and wood construction waste. Additional cellulosics include dedicated cellulosic crops such as switchgrass, hybrid poplar wood, and miscanthus, fiber cane, and fiber sorghum. Five-carbon sugars that are produced from such materials include xylose.

Cellulosic materials are treated to increase the efficiency with which the microbe can utilize the sugar(s) contained within the materials. The invention provides novel methods for the treatment of cellulosic materials after acid explosion so that the materials are suitable for use in a heterotrophic culture of microbes (e.g., microalgae and oleaginous yeast). As discussed above, lignocellulosic biomass is comprised of various fractions, including cellulose, a crystalline polymer of beta 1,4 linked glucose (a six-carbon sugar), hemicellulose, a more loosely associated polymer predominantly comprised of xylose (a five-carbon sugar) and to a lesser extent mannose, galactose, arabinose, lignin, a complex aromatic polymer comprised of sinapyl alcohol and its derivatives, and pectins, which are linear chains of an alpha 1,4 linked polygalacturonic acid. Because of the polymeric structure of cellulose and hemicellulose, the sugars (e.g., monomeric glucose and xylose) in them are not in a form that may be efficiently used (metabolized) by many microbes. For such microbes, further processing of the cellulosic biomass to generate the monomeric sugars that make up the polymers may be very helpful to ensuring that the cellulosic materials are efficiently utilized as a feedstock (carbon source).

In another embodiment of the methods of the invention, the carbon source is glycerol, including acidulated and non-acidulated glycerol byproduct from biodiesel transesterification. In one embodiment, the carbon source includes glycerol and at least one other carbon source. In some cases, all of the glycerol and the at least one other fixed carbon source are provided to the microorganism at the beginning of the fermentation. In some cases, the glycerol and the at least one other fixed carbon source are provided to the microorganism simultaneously at a predetermined ratio. In some cases, the glycerol and the at least one other fixed carbon source are fed to the microbes at a predetermined rate over the course of fermentation.

Some microalgae undergo cell division faster in the presence of glycerol than in the presence of glucose (see PCT Pub. No. 2008/151149). In these instances, two-stage growth processes in which cells are first fed glycerol to rapidly increase cell density, and are then fed glucose to accumulate lipids can improve the efficiency with which lipids are produced. The use of the glycerol byproduct of the transesterification process provides significant economic advantages when put back into the production process. Other feeding methods are provided as well, such as mixtures of glycerol and glucose. Feeding such mixtures also captures the same economic benefits. In addition, the invention provides methods of feeding alternative sugars to microalgae such as sucrose in various combinations with glycerol.

In another embodiment of the methods of the invention, the carbon source is invert sugar. Invert sugar is produced by splitting the sucrose into its monosaccharide components, fructose and glucose. Production of invert sugar may be achieved through several methods that are known in the art. One such method is heating an aqueous solution of sucrose. Often, catalysts are employed in order to accelerate the conversion of sucrose into invert sugar. These catalysts may be biological, for example enzymes such as invertases and sucrases may be added to the sucrose to accelerate the hydrolysis reaction to produce invert sugar. Acid is an example of non-biological catalyst, when paired with heat, can accelerate the hydrolysis reaction. Once the invert sugar is made, it is less prone to crystallization compared to sucrose and thus, provides advantages for storage and in fed batch fermentation, which in the case of heterotrophic cultivation of microbes, including microalgae, there is a need for concentrated carbon source. In one embodiment, the carbon source is invert sugar, preferably in a concentrated form, preferably at least 800 g/liter, at least 900 g/liter, at least 1000 g/liter or at least 1100 g/liter prior to the cultivation step, which is optionally a fed batch cultivation. The invert sugar, preferably in a concentrated form, is fed to the cells over time as the cells grow and accumulate lipid.

In another embodiment of the methods of the invention, the carbon source is sucrose, including a complex feedstock containing sucrose, such as thick cane juice from sugar cane processing. Because of the higher densities of the cultures for heterotrophic oil production, the fixed carbon source (e.g., sucrose, glucose, etc.) is preferably in a concentrated form, preferably at least 500 g/liter, at least 600 g/liter, at least 700 g/liter or at least 800 g/liter of the fixed carbon source prior to the cultivation step, which is optionally a fed batch cultivation in which the material is fed to the cells over time as the cells grow and accumulate lipid. In the some cases, the carbon source is sucrose in the form of thick cane juice, preferably in a concentrated form, preferably at least 60% solids or about 770 g/liter sugar, at least 70% solids or about 925 g/liter sugar, or at least 80% solids or about 1125 g/liter sugar prior to the cultivation step, which is optionally a fed batch cultivation. The concentrated thick cane juice is fed to the cells over time as the cells grow and accumulate lipid In one embodiment, the culture medium further includes at least one sucrose utilization enzyme. In some cases, the culture medium includes a sucrose invertase. In one embodiment, the sucrose invertase enzyme is a secrectable sucrose invertase enzyme encoded by an exogenous sucrose invertase gene expressed by the population of microorganisms. Thus, in some cases, as described in more detail in Section IV, below, the microalgae has been genetically engineered to express a sucrose utilization enzyme, such as a sucrose transporter, a sucrose invertase, a hexokinase, a glucokinase, or a fructokinase.

Complex feedstocks containing sucrose include waste molasses from sugar cane processing; the use of this low-value waste product of sugar cane processing can provide significant cost savings in the production of hydrocarbons and other oils. Another complex feedstock containing sucrose that is useful in the methods of the invention is sorghum, including sorghum syrup and pure sorghum. Sorghum syrup is produced from the juice of sweet sorghum cane. Its sugar profile consists of mainly glucose (dextrose), fructose and sucrose.

Section IV-I. Genetic Engineering Methods and Materials

The present invention provides methods and materials for genentically modifying *Prototheca* cells and recombinant host cells useful in the methods of the present invention, including but not limited to recombinant *Prototheca moriformis, Prototheca zopfii, Prototheca krugani*, and *Prototheca stagnora* host cells. The description of these methods and materials is divided into subsections for the convenience of the reader. In subsection 1, transformation methods are described. In subsection 2, genetic engineering methods using homologous recombination are described. In subsection 3, expression vectors and components are described. In subsection 4, selectable markers and components are described.

1. Engineering Methods—Transformation

Cells may be transformed by any suitable technique including, e.g., biolistics, electroporation (see Maruyama et al. (2004), Biotechnology Techniques 8:821-826), glass bead transformation and silicon carbide whisker transformation. Another method that may be used involves forming protoplasts and using $CaCl_2$ and polyethylene glycol (PEG) to introduce recombinant DNA into microalgal cells (see Kim et al. (2002), *Mar. Biotechnol.* 4:63-73, which reports the use of this method for the transformation of *Chorella ellipsoidea*). Co-transformation of microalgae may be used to introduce two distinct vector molecules into a cell simultaneously (see for example Jakobiak et al. (2004) Protist; 155(4):381-93).

Biolistic methods (see, for example, Sanford, Trends In Biotech. (1988) 6:299-302, U.S. Pat. No. 4,945,050; electroporation (Fromm et al., Proc. Nat'l. Acad. Sci. (USA) (1985) 82:5824-5828); use of a laser beam, microinjection or any other method capable of introducing DNA into a microalgae can also be used for transformation of a *Prototheca* cell.

2. Engineering Methods—Homologous Recombination

Homologous recombination is the ability of complementary DNA sequences to align and exchange regions of homology. Transgenic DNA ("donor") containing sequences homologous to the genomic sequences being targeted ("template") is introduced into the organism and then undergoes recombination into the genome at the site of the corresponding genomic homologous sequences. The mechanistic steps of this process, in most caseees, include: (1) pairing of homologous DNA segments; (2) introduction of double-stranded breaks into the donor DNA molecule; (3) invasion of the template DNA molecule by the free donor DNA ends followed by DNA synthesis; and (4) resolution of double-strand break repair events that result in final recombination products.

The ability to carry out homologous recombination in a host organism has many practical implications for what may be carried out at the molecular genetic level and is useful in the generation of an oleaginous microbe that can produced tailored oils. By its very nature homologous recombination is a precise gene targeting event, hence, most transgenic lines generated with the same targeting sequence will be essentially identical in terms of phenotype, necessitating the screening of far fewer transformation events. Homologous recombination also targets gene insertion events into the host chromosome, resulting in excellent genetic stability, even in the absence of genetic selection. Because different chromosomal loci will likey impact gene expression, even from heterologous promoters/UTRs, homologous recombination may be a method of querying loci in an unfamiliar genome environment and to assess the impact of these environments on gene expression.

Particularly useful genetic engineering applications using homologous recombination is to co-opt specific host regulatory elements such as promoters/UTRs to drive heterologous gene expression in a highly specific fashion. For example, ablation or knockout of desaturase genes/gene families with a heterologous gene encoding a selective marker might be expected to increase overall percentage of saturated fatty acids produced in the host cell. Example 3 describes the homologous recombination targeting constructs and a working example of such desaturase gene ablations or knockouts generated in *Prototheca moriformis*. Another approach to decreasing expression of an endogenous gene is to use an RNA-induced down-regulation or silencing of gene expression including, but not limited to an RNAi or antisense approach, as well as a dsRNA approach. Antisense, RNAi, RNA hairpin, and dsRNA approaches are well known in the art and include the introduction of an expression construct that when expressed as mRNA would lead to the formation of hairpin RNA or an expression construct containing a portion of the target gene that would be transcribed in the antisense orientation. All four approaches would result in the decreased expression of the target gene. Examples 3 and 4 describe expression constructs and working examples of the attenuation, or down-regulation of endogenous *Prototheca moriformis* lipid biosynthesis genes by an RNA hairpin approach.

Because homologous recombination is a precise gene targeting event, it may be used to precisely modify any nucleotide(s) within a gene or region of interest, so long as sufficient flanking regions have been identified. Therefore, homologous recombination may be used as a means to modify regulatory sequences impacting gene expression of RNA and/or proteins. It can also be used to modify protein coding regions in an effort to modify enzyme activites such as substrate specificity, affinities and Km, and thus affecting the desired change in metabolism of the host cell. Homologous recombination provides a powerful means to manipulate the gost genome resulting in gene targeting, gene conversion, gene deletion, gene duplication, gene inversion and exchanging gene expression regulatory elements such as promoters, enhancers and 3'UTRs.

Homologous recombination may be achieve by using targeting constructs containing pieces of endogenous sequences to "target" the gene or region of interest within the endogenous host cell genome. Such targeting sequences can either be located 5' of the gene or region of interest, 3' of the gene/region of interest or even flank the gene/region of interest. Such targeting constructs may be transformed into the host cell either as a supercoiled plasmid DNA with additional vector backbone, a PCR product with no vector backbone, or as a linearized molecule. In some cases, it may be advantageous to first expose the homologous sequences within the transgenic DNA (donor DNA) with a restriction enzyme. This step can increase the recombination efficiency and decrease the occurance of undesired events. Other methods of increasing recombination efficiency include using PCR to generate transforming transgenic DNA containing linear ends homologous to the genomic sequences being targeted.

For purposes of non-limiting illustration, regions of donor DNA sequences that are useful for homologous recombination include the KE858 region of DNA in *Prototheca moriformis*. KE858 is a 1.3 kb, genomic fragment that encompasses part of the coding region for a protein that shares homology with the transfer RNA (tRNA) family of proteins. Southern blots have shown that the KE858 sequence is present in a single copy in the *Prototheca moriformis* (UTEX 1435) genome. This region and Examples of using this region for homologous recombination targeting has been described in PCT Publication No. WO 2010/063032. Another region of donor DNA that is useful is portions of the 6S genomic sequence. The use of this sequence in homologous recombination in *Prototheca morifomis* is described below in the Examples.

3. Vectors and Vector Components

Vectors for transformation of microorganisms in accordance with embodiments of the present invention may be prepared by known techniques familiar to those skilled in the art in view of the disclosure herein. A vector typically contains one or more genes, in which each gene codes for the expression of a desired product (the gene product) and is operably linked to one or more control sequences that regulate gene expression or target the gene product to a particular location in the recombinant cell. To aid the reader, this subsection is divided into subsections. Subsection A describes control sequences typically contained on vectors as well as novel control sequences provided by the present invention. Subsection B describes genes typically contained in vectors as well as novel codon optimization methods and genes prepared using them provided by the invention. Subsection C describes selectable markers contained on vectors and provided by the present invention. Subsection D describes methods and procedures used to identify genes.

A. Control Sequences

Control sequences are nucleic acids that regulate the expression of a coding sequence or direct a gene product to a particular location in or outside a cell. Control sequences that regulate expression include, for example, promoters that regulate transcription of a coding sequence and terminators that terminate transcription of a coding sequence. Another control sequence is a 3' untranslated sequence located at the end of a coding sequence that encodes a polyadenylation signal. Control sequences that direct gene products to particular locations include those that encode signal peptides, which direct the protein to which they are attached to a particular location in or outside the cell.

Thus, an exemplary vector design for expression of an exogenous gene in a microalgae contains a coding sequence for a desired gene product (for example, a selectable marker, a lipid pathway enzyme, or a sucrose utilization enzyme) in operable linkage with a promoter active in microalgae. Alternatively, if the vector does not contain a promoter in operable linkage with the coding sequence of interest, the coding sequence may be transformed into the cells such that it becomes operably linked to an endogenous promoter at the point of vector integration. The promoterless method of transformation has been proven to work in microalgae (see for example Lumbreras, et. al. Plant Journal (1988), 14(4), pp. 441-447.

Many promoters are active in microalgae, including promoters that are endogenous to the algae being transformed, as well as promoters that are not endogenous to the algae being transformed (i.e., promoters from other algae, promoters from higher plants, and promoters from plant viruses or algae viruses). Illustrative exogenous and/or endogenous promoters that are active in microalgae (as well as antibiotic resistance genes functional in microalgae) are described in PCT Pub. No. 2008/151149 and references cited therein The promoter used to express an exogenous gene may be the promoter naturally linked to that gene or may be a heterologous gene. Some promoters are active in more than one species of microalgae. Other promoters are species-specific. Illustrative promoters include promoters such as β-tubulin from *Chlamydomonas reinhardtii*, used in the Examples below, and viral promoters, such as cauliflower mosaic virus (CMV) and *chlorella* virus, which have been shown to be active in multiple species of microalgae (see for example Plant Cell Rep. 2005 March; 23(10-11):727-35; J. Microbiol. 2005 August; 43(4):361-5; Mar Biotechnol (NY). 2002 January; 4(1):63-73). Another promoter that is suitable for use for expression of exogenous genes in *Prototheca* is the *Chlorella sorokiniana* glutamate dehydrogenase promoter/5'UTR. Optionally, at least 10, 20, 30, 40, 50, or 60 nucleotides or more of these sequences containing a promoter are used. Illustrative promoters useful for expression of exogenous genes in *Prototheca* are listed in the sequence listing of this application, such as the promoter of the *Chlorella* HUP1 gene (SEQ ID NO:10) and the *Chlorella ellipsoidea* nitrate reductase promoter (SEQ ID NO:11). *Chlorella* virus promoters can also be used to express genes in *Prototheca*, such as sequence numbers 1 to 7 of U.S. Pat. No. 6,395,965. Additional promoters active in *Prototheca* may be found, for example, in Biochem Biophys Res Commun. 1994 Oct. 14; 204(1):187-94; Plant Mol. Biol. 1994 October; 26(1):85-93; Virology. 2004 Aug. 15; 326(1):150-9; and Virology. 2004 Jan. 5; 318(1):214-23. Other useful promoters are described in detail in the Examples below.

A promoter can generally be characterized as either constitutive or inducible. Constitutive promoters are generally active or function to drive expression at all times (or at certain times in the cell life cycle) at the same level. Inducible promoters, conversely, are active (or rendered inactive) or are significantly up- or down-regulated only in response to a stimulus. Both types of promoters find application in embodiments of the present invention. Inducible promoters useful in embodiments of the present invention include those that mediate transcription of an operably linked gene in response to a stimulus, such as an exogenously provided small molecule (e.g, glucose, as in SEQ ID NO:10), temperature (heat or cold), lack of nitrogen in culture media, pH, etc. Suitable promoters can activate transcription of an essentially silent gene or upregulate, preferably substantially, transcription of an operably linked gene that is transcribed at a low level. Examples below describe additional inducible promoters that are useful in *Prototheca* cells.

The termination region, also referred to as a 3' untranslated region, may be native to the transcriptional initiation region (the promoter), may be native to the DNA sequence of interest, or may be obtainable from another source. See, for example, Chen and Orozco, Nucleic Acids Res. (1988), 16:8411.

In an embodiment of the present invention, control sequences that provide for the compartmentalized expression of an exogenous enzyme or protein are utilized to direct the exogenous enzyme or protein to one or more intracellular ogranelles. Organelles for targeting are chloroplasts, plastids, mitochondria, and endoplasmic reticulum. An additional embodiment of the present invention provides recombinant polynucleotides that enable secretion of a protein outside the cell.

Proteins encoded in the nuclear genome of *Prototheca* may be targeted to the plastid using plastid targeting signals. Plastid targeting sequences endogenous to *Chlorella* are known, such as genes in the *Chlorella* nuclear genome that encode proteins that are targeted to the plastid; see for example GenBank Accession numbers AY646197 and AF499684, and in one embodiment, such control sequences are used in the vectors of the present invention to target expression of a protein to a *Prototheca* plastid.

The Examples below describe the use of algal plastid targeting sequences to target exogenous enzymes and proteins to the correct compartment in the host cell. Algal plastid targeting sequences were obtained from cDNA libraries made using *Prototheca moriformis* and *Chlorella protothecodies* cells and are described in PCT Publication No. WO 2010/063032.

In another embodiment, the expression of an exogenous enzyme or protein in *Prototheca* is targeted to the endoplasmic reticulum. The inclusion of an appropriate retention or sorting signal in an expression vector ensure that proteins are retained in the endoplasmic reticulum (ER) and do not go downstream into Golgi. For example, the IMPACTVECTOR1.3 vector, from Wageningen UR-Plant Research International, includes the well known KDEL (SEQ ID NO: 274) retention or sorting signal. With this vector, ER retention has a practical advantage in that it has been reported to improve expression levels 5-fold or more. The main reason for this appears to be that the ER contains lower concentrations and/or different proteases responsible for post-translational degradation of expressed proteins than are present in the cytoplasm. ER retention signals functional in green microalgae are known. For example, see Proc. Natl. Acad. Sci. USA. 2005 Apr. 26; 102(17):6225-30.

In another embodiment of the present invention, a polypeptide is targeted for secretion outside the cell into the culture media. See Hawkins et al., Current Microbiology Vol. 38 (1999), pp. 335-341 for examples of secretion signals active in *Chlorella* that may be used, in accordance with the methods of the invention, in *Prototheca*.

B. Genes and Codon Optimization

Typically, a gene includes a promoter, coding sequence, and termination control sequences. When assembled by recombinant DNA technology, a gene may be termed an expression cassette and may be flanked by restriction sites for convenient insertion into a vector that is used to introduce the recombinant gene into a host cell. The expression cassette may be flanked by DNA sequences from the genome or other nucleic acid target to facilitate stable integration of the expression cassette into the genome by homologous recombination. Alternatively, the vector and its expression cassette may remain unintegrated, in which case, the vector typically includes an origin of replication, which is capable of providing for replication of the heterologous vector DNA.

A common gene present on a vector is a gene that codes for a protein, the expression of which allows the recombinant cell containing the protein to be differentiated from cells that do not express the protein. Such a gene, and its corresponding gene product, is called a selectable marker. Any of a wide variety of selectable markers may be employed in a transgene construct useful for transforming *Prototheca*. Examples of suitable selectable markers include the G418 resistance gene, the nitrate reductase gene (see Dawson et al. (1997), Current Microbiology 35:356-362), the hygromycin phosphotransferase gene (HPT; see Kim et al. (2002), Mar. Biotechnol. 4:63-73), the neomycin phosphotransferase gene, and the ble gene, which confers resistance to phleomycin (Huang et al. (2007), Appl. Microbiol. Biotechnol. 72:197-205). Methods of determining sensitivity of microalgae to antibiotics are well known. For example, Mol Gen Genet. 1996 Oct. 16; 252(5):572-9.

Other selectable markers that are not antibiotic-based can also be employed in a transgene construct useful for transforming microalgae in general, including *Prototheca* species. Genes that confer the ability to utilize certain carbon sources that were previously unable to be utilized by the microalgae can also be used as a selectable marker. By way of illustration, *Prototheca moriformis* strains typically grow poorly, if at all, on sucrose. Using a construct containing a sucrose invertase gene can confer the ability of positive transformants to grow on sucrose as a carbon substrate. Additional details on using sucrose utilization as a selectable marker along with other selectable markers are discussed below.

For purposes of the present invention, the expression vector used to prepare a recombinant host cell of the invention will include at least two, and often three, genes, if one of the genes is a selectable marker. For example, a genetically engineered *Prototheca* of the invention may be made by transformation with vectors of the invention that comprise, in addition to a selectable marker, one or more exogenous genes, such as, for example, sucrose invertase gene or acyl ACP-thioesterase gene. One or both genes may be expressed using an inducible promoter, which allows the relative timing of expression of these genes to be controlled to enhance the lipid yield and conversion to fatty acid esters. Expression of the two or more exogenous genes may be under control of the same inducible promoter or under control of different inducible (or constitutive) promoters. In the latter situation, expression of a first exogenous gene may be induced for a first period of time (during which expression of a second exogenous gene may or may not be induced) and expression of a second exogenous gene may be induced for a second period of time (during which expression of a first exogenous gene may or may not be induced).

In other embodiments, the two or more exogenous genes (in addition to any selectable marker) are: a fatty acyl-ACP thioesterase and a fatty acyl-CoA/aldehyde reductase, the combined action of which yields an alcohol product.

Other illustrative vectors of embodiments of the invention that express two or more exogenous genes include those encoding both a sucrose transporter and a sucrose invertase enzyme and those encoding both a selectable marker and a secreted sucrose invertase. The recombinant *Prototheca* transformed with either type of vector produce lipids at lower manufacturing cost due to the engineered ability to use sugar cane (and sugar cane-derived sugars) as a carbon source. Insertion of the two exogenous genes described above may be combined with the disruption of polysaccharide biosynthesis through directed and/or random mutagenesis, which steers ever greater carbon flux into lipid production. Individually and in combination, trophic conversion, engineering to alter lipid production and treatment with exogenous enzymes alter the lipid composition produced by a microorganism. The alteration may be a change in the amount of lipids produced, the amount of one or more hydrocarbon species produced relative to other lipids, and/or the types of lipid species produced in the microorganism. For example, microalgae may be engineered to produce a higher amount and/or percentage of TAGs.

For optimal expression of a recombinant protein, it is beneficial to employ coding sequences that produce mRNA with codons preferentially used by the host cell to be transformed. Thus, proper expression of transgenes can require that the codon usage of the transgene matches the specific codon bias of the organism in which the transgene is being expressed. The precise mechanisms underlying this effect are many, but include the proper balancing of available aminoacylated tRNA pools with proteins being synthesized in the cell, coupled with more efficient translation of the transgenic messenger RNA (mRNA) when this need is met. When codon usage in the transgene is not optimized, available tRNA pools are not sufficient to allow for efficient translation of the heterologous mRNA resulting in ribosomal stalling and termination and possible instability of the transgenic mRNA.

The present invention provides codon-optimized nucleic acids useful for the successful expression of recombinant proteins in *Prototheca*. Codon usage in *Prototheca* species was analyzed by studying cDNA sequences isolated from *Prototheca moriformis*. This analysis represents the interrogation over 24,000 codons and resulted in Table 2 below.

TABLE 2

Illustrative preferred codon usage in *Prototheca* strains.

| | | | |
|---|---|---|---|
| Ala | GCG | 345 | (0.36) |
| | GCA | 66 | (0.07) |
| | GCT | 101 | (0.11) |
| | GCC | 442 | (0.46) |
| Cys | TGT | 12 | (0.10) |
| | TGC | 105 | (0.90) |
| Asp | GAT | 43 | (0.12) |
| | GAC | 316 | (0.88) |
| Glu | GAG | 377 | (0.96) |
| | GAA | 14 | (0.04) |
| Phe | TTT | 89 | (0.29) |
| | TTC | 216 | (0.71) |
| Gly | GGG | 92 | (0.12) |
| | GGA | 56 | (0.07) |
| | GGT | 76 | (0.10) |
| | GGC | 559 | (0.71) |
| His | CAT | 42 | (0.21) |
| | CAC | 154 | (0.79) |
| Ile | ATA | 4 | (0.01) |
| | ATT | 30 | (0.08) |
| | ATC | 338 | (0.91) |
| Lys | AAG | 284 | (0.98) |
| | AAA | 7 | (0.02) |

TABLE 2-continued

Illustrative preferred codon usage in Prototheca strains.

| | | | |
|---|---|---|---|
| Leu | TTG | 26 | (0.04) |
| | TTA | 3 | (0.00) |
| | CTG | 447 | (0.61) |
| | CTA | 20 | (0.03) |
| | CTT | 45 | (0.06) |
| | CTC | 190 | (0.26) |
| Met | ATG | 191 | (1.00) |
| Asn | AAT | 8 | (0.04) |
| | AAC | 201 | (0.96) |
| Pro | CCG | 161 | (0.29) |
| | CCA | 49 | (0.09) |
| | CCT | 71 | (0.13) |
| | CCC | 267 | (0.49) |
| Gln | CAG | 226 | (0.82) |
| | CAA | 48 | (0.18) |
| Arg | AGG | 33 | (0.06) |
| | AGA | 14 | (0.02) |
| | CGG | 102 | (0.18) |
| | CGA | 49 | (0.08) |
| | CGT | 51 | (0.09) |
| | CGC | 331 | (0.57) |
| Ser | AGT | 16 | (0.03) |
| | AGC | 123 | (0.22) |
| | TCG | 152 | (0.28) |
| | TCA | 31 | (0.06) |
| | TCT | 55 | (0.10) |
| | TCC | 173 | (0.31) |
| Thr | ACG | 184 | (0.38) |
| | ACA | 24 | (0.05) |
| | ACT | 21 | (0.05) |
| | ACC | 249 | (0.52) |
| Val | GTG | 308 | (0.50) |
| | GTA | 9 | (0.01) |
| | GTT | 35 | (0.06) |
| | GTC | 262 | (0.43) |
| Trp | TGG | 107 | (1.00) |
| Tyr | TAT | 10 | (0.05) |
| | TAC | 180 | (0.95) |
| Stop | TGA/TAG/TAA | | |

In other embodiments, the gene in the recombinant vector has been codon-optimized with reference to a microalgal strain other than a *Prototheca* strain. For example, methods of recoding genes for expression in microalgae are described in U.S. Pat. No. 7,135,290. Additional information for codon optimization is available, e.g., at the codon usage database of GenBank.

While the methods and materials of the invention allow for the introduction of any exogenous gene into *Prototheca*, genes relating to sucrose utilization and lipid pathway modification are of particular interest, as discussed in the following sections.

C. Selectable Markers

Sucrose Utilization

In one embodiment, the recombinant *Prototheca* cell of the invention further contains one or more exogenous sucrose utilization genes. In various embodiments, the one or more genes encode one or more proteins selected from the group consisting of a fructokinase, a glucokinase, a hexokinase, a sucrose invertase, a sucrose transporter. For example, expression of a sucrose transporter and a sucrose invertase allows *Prototheca* to transport sucrose into the cell from the culture media and hydrolyze sucrose to yield glucose and fructose. Optionally, a fructokinase may be expressed as well in instances where endogenous hexokinase activity is insufficient for maximum phosphorylation of fructose. Examples of suitable sucrose transporters are GenBank accession numbers CAD91334, CAB92307, and CAA53390. Examples of suitable fructokinases are GenBank accession numbers P26984, P26420 and CAA43322.

In one embodiment, the present invention provides a *Prototheca* host cell that secretes a sucrose invertase. Secretion of a sucrose invertase obviates the need for expression of a transporter that can transport sucrose into the cell. This is because a secreted invertase catalyzes the conversion of a molecule of sucrose into a molecule of glucose and a molecule of fructose, both of which may be transported and utilized by microbes provided by the invention. For example, expression of a sucrose invertase with a secretion signal (such as that of SEQ ID NO: 12 (from yeast), SEQ ID NO: 13 (from higher plants), SEQ ID NO: 14 (eukaryotic consensus secretion signal), and SEQ ID NO: 15 (combination of signal sequence from higher plants and eukaryotic consensus) generates invertase activity outside the cell. Expression of such a protein, as enabled by the genetic engineering methodology disclosed herein, allows cells already capable of utilizing extracellular glucose as an energy source to utilize sucrose as an extracellular energy source.

*Prototheca* species expressing an invertase in media containing sucrose are a preferred microalgal species for the production of oil. The expression and extracellular targeting of this fully active protein allows the resulting host cells to grow on sucrose, whereas their non-transformed counterparts cannot. Thus, the present invention provides *Prototheca* recombinant cells with a codon-optimized invertase gene (SEQ ID NO: 16), including but not limited to the yeast invertase gene, integrated into their genome such that the invertase gene is expressed as assessed by invertase activity and sucrose hydrolysis.

Examples of suitable sucrose invertases include those identified by GenBank accession numbers CAB95010, NP_012104 (SEQ ID NO: 17), and CAA06839. Non-limiting examples of suitable invertases include those described in PCT Publication No. WO 2010/063032, incorporated herein by reference.

The secretion of an invertase to the culture medium by *Prototheca* enable the cells to grow as well on waste molasses from sugar cane processing as they do on pure reagent-grade glucose; the use of this low-value waste product of sugar cane processing can provide significant cost savings in the production of lipids and other oils. Thus, the present invention provides a microbial culture containing a population of *Prototheca* microorganisms, and a culture medium comprising (i) sucrose and (ii) a sucrose invertase enzyme. In various embodiments the sucrose in the culture comes from sorghum, sugar beet, sugar cane, molasses, or depolymerized cellulosic material (which may optionally contain lignin). In another aspect, the methods and reagents of the invention significantly increase the number and type of feedstocks that may be utilized by recombinant *Prototheca*. While the microbes exemplified here are altered such that they can utilize sucrose, the methods and reagents of the invention may be applied so that feedstocks such as cellulosics are utilizable by an engineered host microbe of the invention with the ability to secrete cellulases, pectinases, isomerases, or the like, such that the breakdown products of the enzymatic reactions are no longer just simply tolerated but rather utilized as a carbon source by the host.

D. Sequence Determination

A variety of methods may be employed for the identification of gene sequences and amino acid sequences of lipid biosynthetic pathway genes and enzymes. Sequences of polynucleotides (e.g., genomic DNA, cDNA, RNA, PCR-amplified nucleotides) may be determined through sequencing technologies including but not limited to Sanger sequencing, pyrosequencing, sequencing by synthesis, sequencing by oligonucleotide probe ligation, and real time sequencing. One skilled in the art may compare nucleotide sequences to published databases of genomic sequences or expressed sequences. Where a DNA sequence is determined or disclosed, one skilled in the art may compare segments from published exon sequences, or may assemble exon sequences into a reconstructed sequence that does not contain intronic sequences. Sequences of polynucleotides may also be translated into amino acids, peptides, polypeptides or proteins through a variety of methods including but not limited to manual translation or computer-automated translation with bioinformatics software commonly known in the art. Comparison methods of sequenced DNA, RNA, amino acids, peptides, or proteins may include but are not limited to manual evaluation of the sequence or computer-automated sequence comparison and identification using algorithms such as BLAST (Basic Local 55 Alignment Search Tool; Altschul, S. E, et al, (1993)/. *Mol. Biol.* 215:403-410; see also www.ncbi.nlm.nih.gov/BLAST/).

The instant specification teaches partial or complete amino acid and nucleotide sequences encoding one or more particular microbial genes and proteins. The skilled artisan, having the benefit of the sequences as reported herein, may now use all or a portion of the disclosed sequences for purposes known to those skilled in this art.

Genomic sequencing of *P. moriformis* (UTEX 1435) was performed using Illumina HiSeq and paired-end reads were obtained (100 bp reads, ~450 bp fragment size). Genomic DNA is prepared using standard protocols and fragmented by hydrodynamic shearing. Genomic data using Roche 454 technology was also obtained (400 bp fragment size) as were 8 kb mate pair libraries. Transcriptome data consisted of Illumina HiSeq paired end data (100 bp reads, ~450 bp fragment size). Sequencing reads were quality trimmed and filtered using fastx tools. Genome data was assembled using Velvet (Zerbino et al, Velvet: algorithms for de novo short read assembly using de Bruijn graphs, Genome Research, May 2008) using an optimized kmer and other default parameters, and using the Pacific Biosciences ALLORA assembler. Annotation was performed using the MAKER pipeline and genes were identified by BLAST against the nr database (NCBI). In addition, a cDNA library was constructed, and ~1200 cDNAs from this library were sequenced using Sanger sequencing. These cDNAs where then annotated and used as initial entry points to find transcripts from Illumina transcriptomes and to help verify the accuracy of Illumina transcriptome and genome sequence data. Pacific Biosciences technology was also utilized to obtain long reads from genomic samples. A given base position is indicated with a code as shown in the table below. In some cases, two representative sequences were constructed, with the two possible bases respectively, as well as corresponding protein translations for the two alternatives. Such sequences are referred to as "version 1" and "version 2".

| Base codes | |
|---|---|
| A | Adenine |
| C | Cytosine |
| G | Guanine |
| T (or U) | Thymine (or Uracil) |
| R | A or G |
| Y | C or T |
| S | G or C |
| W | A or T |
| K | G or T |
| M | A or C |
| B | C or G or T |
| D | A or G or T |
| H | A or C or T |
| V | A or C or G |
| N | any base |
| . or - | gap |
| * | stop/nonsense codon |
| ? | unknown amino acid |

Section IV-II. Genetically Engineered *Prototheca* Cells

In a first aspect, the present invention provides a genetically engineered *Prototheca* cell in one or more lipid biosynthesis genes have been modified to increase or decrease expression of such one or more genes such that the fatty acid profile of the genetically engineered strain differs from that of the strain from which it was derived. In one embodiment, at least two genes have been modified. In various embodiments, the genetic modifications include one or more of the following modifications: (i) attenuation of a gene or its enzymatic product; and (ii) increased expression of a gene or its enzymatic product; (iii) altered activity of a gene or its enzymatic product.

In various embodiments, the genetically engineered cell has one or more attenuated genes, wherein the genes attenuated have been attenuated by a means selected from the group consisting of a homologous recombination event and introduction of an exogenous gene that codes for an interfering RNA. In various embodiments, one or more alleles of a gene are attenuated.

In various embodiments, the genetically engineered cell has one or more over-expressed genes, wherein the genes over-expressed have been up-regulated by a means selected from the group consisting of introduction of additional copies of said gene into said cell; introduction of new expression control elements for said gene; and alteration of the protein-coding sequence of the gene. In various embodiments, one or more alleles of a gene are over-expressed.

In various embodiments, the modified genes of the genetically engineered cell are selected from the group consisting of *Prototheca* lipid biosynthesis genes presented in Table 1. In various embodiments, the genetically engineered cell comprises an exogenous gene selected from the group consisting of *Prototheca* lipid biosynthesis genes presented in Table 1. In various embodiments, the genetically engineered cell comprises one more overexpressed alleles of a gene, the gene selected from the group consisting of *Prototheca* lipid biosynthesis genes presented in Table 1. In various embodiments, the genetically engineered cell has an attenuated gene selected from the group consisting of *Prototheca* lipid biosynthesis genes presented in Table 1. In various embodiments, the genetically engineered cell has one more attenuated alleles of a gene, the gene selected from the group consisting of *Prototheca* lipid biosynthesis genes presented in Table 1.

In various embodiments, the genetically engineered cell has one or more overexpressed genes, wherein the expression of the genes have been increased by a means selected from the group consisting of introduction of additional copies of said gene into said cell; and introduction of new expression control elements for said gene. In various embodiments, the overexpressed gene is an exogenous gene.

In various embodiments, the modified genes of the genetically engineered cell are selected from the group consisting of *Prototheca* lipid biosynthesis genes presented in Table 1.

In various embodiments, the genetically engineered cell has an up-regulated gene selected from the group consisting of *Prototheca* lipid biosynthesis genes presented in Table 1. In various embodiments, the genetically engineered cell has an attenuated gene selected from the group consisting of *Prototheca* lipid biosynthesis genes presented in Table 1. In various embodiments, the genetically engineered cell has a fatty acid profile selected from the group consisting of: 3% to 60% C8:0, 3% to 60% C10:0, 3% to 70% C12:0, 3% to 95% C14:0, 3% to 95% C16:0, 3% to 95% C18:0, 3% to 95% C18:1, 3% to 60% C18:2, 1% to 60% C18:3 or combinations thereof. In various embodiments, the ratio of C10:0 to C12:0 is at least 3:1. In various embodiments, the ratio of C12:0 to C14:0 is at least 3:1. In some cases, the ratio of C10:0 to C14:0 is at least 10:1. In various embodiments, the genetically engineered cell has a fatty acid profile of at least 40% saturated fatty acids, of at least 60% saturated fatty acids, or at least 85% saturated fatty acids. In various embodiments, the genetically engineered cell has a fatty acid profile of at least 85% unsaturated fatty acids, of at least 90% unsaturated fatty acids, of at least 95% unsaturated fatty acids, or at least 97% unsaturated fatty acids.

An embodiment of the present invention also provides recombinant *Prototheca* cells that have been modified to contain one or more exogenous genes encoding lipid biosyntheis enzymes such as, for example, a fatty acyl-ACP thioesterase (see Example 5) or a ketoacyl-ACP synthase II (see Example 6). In some embodiments, genes encoding a fatty acyl-ACP thioesterase and a naturally co-expressed acyl carrier protein are transformed into a *Prototheca* cell, optionally with one or more genes encoding other lipid biosynthesis genes. In other embodiments, the ACP and the fatty acyl-ACP thioesterase may have an affinity for one another that imparts an advantage when the two are used together in the microbes and methods of the present invention, irrespective of whether they are or are not naturally co-expressed in a particular tissue or organism. Thus, embodiments of the present invention contemplate both naturally co-expressed pairs of these enzymes as well as those that share an affinity for interacting with one another to facilitate cleavage of a length-specific carbon chain from the ACP.

In still other embodiments, an exogenous gene encoding a desaturase is transformed into the *Prototheca* cell in conjunction with one or more genes encoding other lipid biosynthesis genes to provide modifications with respect to lipid saturation. In other embodiments, an endogenous desaturase gene is overexpressed (e.g., through the introduction of additonal copies off the gene) in a *Prototheca* cell. In some embodiments, the desaturase may be selected with reference to a desired carbon chain length, such that the desaturase is capable of making location specific modifications within a specified carbon-length substrate, or substrates having a carbon-length within a specified range. In another embodiment, if the desired fatty acid profile is an increase in monounsaturates (such as C16:1 and/or C18:1) overexpression of a SAD or expression of a heterologous SAD may be coupled with the silencing or inactivation (e.g., through mutation, RNAi, antisense, or knockout of an endogenous desaturase gene, etc.) of a fatty acyl desaturase (FAD) or another desaturase gene.

In other embodiments, the *Prototheca* cell has been modified to have an attenuated endogenous desaturase gene, wherein the attenuation renders the gene or desaturase enzyme inactive. In some cases, the mutated endogenous desaturase gene is a fatty acid desaturase (FAD). In other cases, the mutated endogenous desaturase gene is a stearoyl acyl carrier protein desaturase (SAD). Example 4 describes the targeted ablation of stearoyl-ACP desaturases and delta 12 fatty acid desaturases. Example 4 also describes the use of RNA antisense constructs to decrease the expression of an endogenous desaturase gene. Example In some cases, it may be advantageous to pair one or more of the genetic engineering techniques in order to achieve a trangenic cell that produces the desired fatty acid profile. In one embodiment, a *Prototheca* cell comprises an attenuated endogenous thioestease gene and one or more exogenous gene. In non-limiting examples, a *Prototheca* cell with an attenuated endogenous thioesterase gene can also express an exogenous fatty acyl-ACP thioesterase gene and/or a sucrose invertase gene. Example 5 below describes a transgenic *Prototheca* cell containing a targeted ablation or knockout of an endogenous thioesterase and also expresses a *Cuphea wrightii* FatB2 C10:0-C14:0 preferring thioesterase and a sucrose invertase.

In other embodiments, one allele of a *Prototheca* lipid biosyntheis gene has been attenuated. In additional embodiments, two or more alleles of a *Prototheca* lipid biosyntheis gene have been attenuated. In additional embodiments, one or more alleles of different *Prototheca* lipid biosyntheis genes have been attenuated. Example 37 below describes the targeted knockout of multiple alleles of stearoyl-ACP desaturase. Example 34 below describes the targeted knockout of multiple alleles of acyl-ACP thioesterase. Example 8 below describes the targeted knockout of acyl-ACP thioesterase and fatty acid desaturase. In some cases, the targeted knockout of different alleles of a gene may result in different effects on fatty acid profiles.

Section V. Microbial Oils

For the production of oil in accordance with the methods of the invention, it is preferable to culture cells in the dark, as is the case, for example, when using extremely large (40,000 liter and higher) fermentors that do not allow light to strike the culture. *Prototheca* species are grown and propagated for the production of oil in a medium containing a fixed carbon source and in the absence of light; such growth is known as heterotrophic growth.

As an example, an inoculum of lipid-producing microalgal cells are introduced into the medium; there is a lag period (lag phase) before the cells begin to propagate. Following the lag period, the propagation rate increases steadily and enters the log, or exponential, phase. The exponential phase is in turn followed by a slowing of propagation due to decreases in nutrients such as nitrogen, increases in toxic substances, and quorum sensing mechanisms. After this slowing, propagation stops, and the cells enter a stationary phase or steady growth state, depending on the particular environment provided to the cells. For obtaining lipid rich biomass, the culture is typically harvested well after then end of the exponential phase, which may be terminated early by allowing nitrogen or another key nutrient (other than carbon) to become depleted, forcing the cells to convert the carbon sources, present in excess, to lipid. Culture condition parameters may be manipulated to optimize total oil production, the combination of lipid species produced, and/or production of a specific oil.

As discussed above, a bioreactor or fermentor is used to allow cells to undergo the various phases of their growth cycle. As an example, an inoculum of lipid-producing cells may be introduced into a medium followed by a lag period (lag phase) before the cells begin growth. Following the lag period, the growth rate increases steadily and enters the log, or exponential, phase. The exponential phase is in turn followed by a slowing of growth due to decreases in nutrients and/or increases in toxic substances. After this slowing, growth stops, and the cells enter a stationary phase or steady state, depending on the particular environment provided to the cells. Lipid production by cells disclosed herein can occur during the log phase or thereafter, including the stationary phase wherein nutrients are supplied, or still available, to allow the continuation of lipid production in the absence of cell division.

Preferably, microorganisms grown using conditions described herein and known in the art comprise at least about 20% by weight of lipid, preferably at least about 40% by weight, more preferably at least about 50% by weight, and most preferably at least about 60% by weight. Process conditions may be adjusted to increase the yield of lipids suitable for a particular use and/or to reduce production cost. For example, in certain embodiments, a microalgae is cultured in the presence of a limiting concentration of one or more nutrients, such as, for example, nitrogen, phosphorous, or sulfur, while providing an excess of fixed carbon energy such as glucose. Nitrogen limitation tends to increase microbial lipid yield over microbial lipid yield in a culture in which nitrogen is provided in excess. In particular embodiments, the increase in lipid yield is at least about: 10%, 50%, 100%, 200%, or 500%. The microbe may be cultured in the presence of a limiting amount of a nutrient for a portion of the total culture period or for the entire period. In particular embodiments, the nutrient concentration is cycled between a limiting concentration and a non-limiting concentration at least twice during the total culture period. Lipid content of cells may be increased by continuing the culture for increased periods of time while providing an excess of carbon, but limiting or no nitrogen.

In another embodiment, lipid yield is increased by culturing a lipid-producing microbe (e.g., microalgae) in the presence of one or more cofactor(s) for a lipid pathway enzyme (e.g., a fatty acid synthetic enzyme). Generally, the concentration of the cofactor(s) is sufficient to increase microbial lipid (e.g., fatty acid) yield over microbial lipid yield in the absence of the cofactor(s). In a particular embodiment, the cofactor(s) are provided to the culture by including in the culture a microbe (e.g., microalgae) containing an exogenous gene encoding the cofactor(s). Alternatively, cofactor(s) may be provided to a culture by including a microbe (e.g., microalgae) containing an exogenous gene that encodes a protein that participates in the synthesis of the cofactor. In certain embodiments, suitable cofactors include any vitamin required by a lipid pathway enzyme, such as, for example: biotin, pantothenate. Genes encoding cofactors suitable for use in the invention or that participate in the synthesis of such cofactors are well known and may be introduced into microbes (e.g., microalgae), using contructs and techniques such as those described above.

The specific examples of bioreactors, culture conditions, and heterotrophic growth and propagation methods described herein may be combined in any suitable manner to improve efficiencies of microbial growth and lipid and/or protein production.

Microalgal biomass with a high percentage of oil/lipid accumulation by dry weight has been generated using different methods of culture, which are known in the art (see PCT Pub. No. 2008/151149). Microalgal biomass generated by the culture methods described herein and useful in accordance with the present invention comprises at least 2% microalgal oil by dry weight. In some embodiments, the microalgal biomass comprises at least 10%, at least 25%, at least 50%, at least 55%, or at least 60% microalgal oil by dry weight. In some embodiments, the microalgal biomass contains from 10-90% microalgal oil, from 25-75%.

The microalgal oil of the biomass described herein, or extracted from the biomass for use in the methods and compositions of the present invention can comprise glycerolipids with one or more distinct fatty acid ester side chains. Glycerolipids are comprised of a glycerol molecule esterified to one, two or three fatty acid molecules, which may be of varying lengths and have varying degrees of saturation. The length and saturation characteristics of the fatty acid molecules (and the microalgal oils) may be manipulated to modify the properties or proportions of the fatty acid molecules in the microalgal oils of the present invention via culture conditions or via lipid pathway engineering, as described in more detail in Section IV, below. Thus, specific blends of algal oil may be prepared either within a single species of algae by mixing together the biomass or algal oil from two or more species of microalgae, or by blending algal oil of the invention with oils from other sources such as soy, rapeseed, canola, palm, palm kernel, coconut, corn, waste vegetable, Chinese tallow, olive, sunflower, cottonseed, chicken fat, beef tallow, porcine tallow, microalgae, macroalgae, microbes, *Cuphea*, flax, peanut, choice white grease, lard, *Camelina sativa*, mustard seed, cashew nut, oats, lupine, kenaf, *calendula*, kelp, coffee, linseed (flax), hazelnut, *euphorbia*, pumpkin seed, coriander, *camellia*, sesame, safflower, rice, tung tree, cocoa, copra, pium poppy, castor beans, pecan, jojoba, *macadamia*, Brazil nuts, avocado, petroleum, or a distillate fraction of any of the preceding oils.

The oil composition, i.e., the properties and proportions of the fatty acid constituents of the glycerolipids, can also be manipulated by combining biomass or oil from at least two distinct species of microalgae. In some embodiments, at least two of the distinct species of microalgae have different glycerolipid profiles. The distinct species of microalgae may be cultured together or separately as described herein, preferably under heterotrophic conditions, to generate the respective oils. Different species of microalgae can contain different percentages of distinct fatty acid constituents in the cell's glycerolipids Generally, *Prototheca* strains have very little or no fatty acids with the chain length C8-C14. For example, *Prototheca moriformis* (UTEX 1435), *Prototheca krugani* (UTEX 329), *Prototheca stagnora* (UTEX 1442) and *Prototheca zopfii* (UTEX 1438) contains no (or undectable amounts) C8 fatty acids, between 0-0.01% C10 fatty acids, between 0.03-2.1% C12 fatty acids and between 1.0-1.7% C14 fatty acids.

Microalgal oil can also include other constituents produced by the microalgae, or incorporated into the microalgal oil from the culture medium. These other constituents may be present in varying amount depending on the culture conditions used to culture the microalgae, the species of microalgae, the extraction method used to recover microalgal oil from the biomass and other factors that may affect microalgal oil composition. Non-limiting examples of such constituents include carotenoids, present from 0.025-0.3 mcg/g, preferably from 0.05 to 0.244 micrograms/gram, of oil; chlorophyll A present from 0.025-0.3 mcg/g, preferably from 0.045 to 0.268 micrograms/gram, of oil; total chlorophyll of less than 0.03 mcg/g, preferably less than 0.025 micrograms/gram, of oil; gamma tocopherol present from 35-175 mcg/g, preferably from 38.3-164 micrograms/gram, of oil; total tocopherols present from 50-300 mcg/g, preferably from 60.8 to 261.7 microgram/gram, of oil; less than 0.5%, preferably less than 0.25%, brassicasterol, campesterol, stigmasterol, or betasitosterol; total tocotrienols less than 300 micrograms/ gram of oil; and total tocotrienols present from 225-350 mcg/g, preferably from 249.6 to 325.3 micrograms/gram, of oil.

Other constituents can include, without limitation, phospholipids, tocopherols, tocotrienols, carotenoids (e.g., alpha-carotene, beta-carotene, lycopene, etc.), xanthophylls (e.g., lutein, zeaxanthin, alpha-cryptoxanthin and beta-crytoxanthin), and various organic or inorganic compounds. In some cases, the oil extracted from *Prototheca* species comprises between 0.001 to 0.05, preferably from 0.003 to 0.039, microgram lutein/gram of oil, less than 0.005, preferably less than 0.003, micrograms lycopene/gram of oil; and less than 0.005, preferably less than 0.003, microgram beta carotene/gram of oil.

The stable carbon isotope value $\delta 13C$ is an expression of the ratio of 13C/12C relative to a standard (e.g. PDB, carbonite of fossil skeleton of *Belemnite americana* from Peedee formation of South Carolina). The stable carbon isotope value $\delta 13C$ (‰) of the oils can be related to the $\delta 13C$ value of the feedstock used. In some embodiments the oils are derived from oleaginous organisms heterotrophically grown on sugar derived from a C4 plant such as corn or sugarcane. In some embodiments the $\delta 13C$ (‰) of the oil is from $-10$ to $-17$‰ or from $-13$ to $-16$‰.

In a second aspect, the present invention provides methods for obtaining microbial oil comprising culturing a genetically engineered *Prototheca* cell of the invention under conditions such that oil is produced. In various embodiments, the microbial oil has a fatty acid profile selected from the group consisting of: 0.1% to 60% C8:0, 0.1% to 60% C10:0, 0.1% to 60% C12:0, 0.1% to 95% C14:0, 1% to 95% C16:0, 0.1% to 95% C18:0, 0.1% to 95% C18:1, 0.1% to 60% C18:2, 0.1% to 60% C18:3 or combinations thereof. In various embodiments, the ratio of C10:0 to C12:0 is at least 3:1. In some cases, the ratio of C10:0 to C14:0 is at least 10:1. In some cases, the ratio of C10:0 to C14:0 is at least 2:1. In some cases, the ratio of C12:0 to C14:0 is at least 2:1. In some cases, the ratio of C12:0 to C14:0 is at least 3:1. In various embodiments, the genetically engineered cell has a fatty acid profile of at least 40% saturated fatty acids, of at least 60% saturated fatty acids, or at least 85% saturated fatty acids. In various embodiments, the genetically engineered cell has a fatty acid profile of at least 85% unsaturated fatty acids, of at least 90% unsaturated fatty acids, of at least 95% unsaturated fatty acids, or at least 97% unsaturated fatty acids.

In a third aspect, the present invention provides microbial oils and foods, fuels, and chemicals containing said oil or a chemical derived therefrom.

Section VI. Nucleic Acids

In a fifth aspect, the present invention provides recombinant nucleic acids useful in methods for making genetically modified *Prototheca* and other cells. Embodiments of the present invention provide polynucleotides that encode some portion of a coding sequence of a *Prototheca* lipid biosynthesis gene.

In various embodiments, these nucleic acids include expression cassettes, which consist of a coding sequence and control sequences that regulate expression of the coding sequence, which may code for an mRNA that encodes a lipid biosynthesis enzyme or for an RNAi that acts to suppress expression of a fatty acid biosynthesis gene.

In other embodiments, these nucleic acids are expression vectors that include one or more expression cassettes and stably replicate in a *Prototheca* or other host cell, either by integration into chromosomal DNA of the host cell or as freely replicating plasmids.

In other embodiments, these nucleic acids comprise a portion of a *Prototheca* lipid biosynthesis gene, which portion may be a portion of a coding sequence, an exon, or a control element. Such nucleic acids are useful in the construction of expression cassettes for *Prototheca* and non-*Prototheca* host cells, for integration of exogenous DNA into *Prototheca* host cells, for regulating expression of exogenous genes expressed in *Prototheca* and non-*Prototheca* host cells, and for construction of nucleic acids useful for inactivating *Prototheca* lipid synthesis genes such as through homologous recombination or antisense RNA mediated knockdown.

EXAMPLES

Example 1

Methods for Culturing *Prototheca*

*Prototheca* strains were cultivated to achieve a high percentage of oil by dry cell weight. Cryopreserved cells were thawed at room temperature and 500 ul of cells were added to 4.5 ml of medium (4.2 g/L $K_2HPO_4$, 3.1 g/L $NaH_2PO_4$, 0.24 g/L $MgSO_4.7H_2O$, 0.25 g/L Citric Acid monohydrate, 0.025 g/L $CaCl_2$ $2H_2O$, 2 g/L yeast extract) plus 2% glucose and grown for 7 days at 28° C. with agitation (200 rpm) in a 6-well plate. Dry cell weights were determined by centrifuging 1 ml of culture at 14,000 rpm for 5 min in a pre-weighed Eppendorf tube. The culture supernatant was discarded and the resulting cell pellet washed with 1 ml of deionized water. The culture was again centrifuged, the supernatant discarded, and the cell pellets placed at $-80°$ C. until frozen. Samples were then lyophilized for 24 hrs and dry cell weights calculated. For determination of total lipid in cultures, 3 ml of culture was removed and subjected to analysis using an Ankom system (Ankom Inc., Macedon, N.Y.) according to the manufacturer's protocol. Samples were subjected to solvent extraction with an Amkom XT10 extractor according to the manufacturer's protocol. Total lipid was determined as the difference in mass between acid hydrolyzed dried samples and solvent extracted, dried samples. Percent oil dry cell weight measurements are shown in Table 3.

TABLE 3

| Percent oil by dry cell weight | | |
| --- | --- | --- |
| Species | Strain | % Oil |
| Prototheca stagnora | UTEX 327 | 13.14 |
| Prototheca moriformis | UTEX 1441 | 18.02 |
| Prototheca moriformis | UTEX 1435 | 27.17 |

Microalgae samples from multiple strains from the genus *Prototheca* were genotyped. Genomic DNA was isolated from algal biomass as follows. Cells (approximately 200 mg) were centifuged from liquid cultures 5 minutes at 14,000×g. Cells were then resuspended in sterile distilled water, centrifuged 5 minutes at 14,000×g and the supernatant discarded. A single glass bead ~2 mm in diameter was added to the biomass and tubes were placed at −80° C. for at least 15 minutes. Samples were removed and 150 µl of grinding buffer (1% Sarkosyl, 0.25 M Sucrose, 50 mM NaCl, 20 mM EDTA, 100 mM Tris-HCl, pH 8.0, RNase A 0.5 ug/ul) was added. Pellets were resuspended by vortexing briefly, followed by the addition of 40 ul of 5M NaCl. Samples were vortexed briefly, followed by the addition of 66 µl of 5% CTAB (Cetyl trimethylammonium bromide) and a final brief vortex. Samples were next incubated at 65° C. for 10 minutes after which they were centrifuged at 14,000×g for 10 minutes. The supernatant was transferred to a fresh tube and extracted once with 300 µl of Phenol:Chloroform:Isoamyl alcohol 12:12:1, followed by centrifugation for 5 minutes at 14,000×g. The resulting aqueous phase was transferred to a fresh tube containing 0.7 vol of isopropanol (~190 µl), mixed by inversion and incubated at room temperature for 30 minutes or overnight at 4° C. DNA was recovered via centrifugation at 14,000×g for 10 minutes. The resulting pellet was then washed twice with 70% ethanol, followed by a final wash with 100% ethanol. Pellets were air dried for 20-30 minutes at room temperature followed by resuspension in 50 µl of 10 mM TrisCl, 1 mM EDTA (pH 8.0).

Five µl of total algal DNA, prepared as described above, was diluted 1:50 in 10 mM Tris, pH 8.0. PCR reactions, final volume 20 µl, were set up as follows. Ten µl of 2× iProof HF master mix (BIO-RAD) was added to 0.4 µl primer SZ02613 (5'-TGTTGAAGAATGAGCCGGCGAC-3') (SEQ ID NO: 275) at 10 mM stock concentration. This primer sequence runs from position 567-588 in GenBank accession no. L43357 and is highly conserved in higher plants and algal plastid genomes. This was followed by the addition of 0.4 µl primer SZ02615 (5'-CAGTGAGCTATTACGCACTC-3') (SEQ ID NO: 276) at 10 mM stock concentration. This primer sequence is complementary to position 1112-1093 in GenBank accession no. L43357 and is highly conserved in higher plants and algal plastid genomes. Next, 5 µl of diluted total DNA and 3.2 µl dH$_2$O were added. PCR reactions were run as follows: 98° C., 45"; 98° C., 8"; 53° C., 12"; 72° C., 20" for 35 cycles followed by 72° C. for 1 min and holding at 25° C. For purification of PCR products, 20 µl of 10 mM Tris, pH 8.0, was added to each reaction, followed by extraction with 40 µl of Phenol:Chloroform:isoamyl alcohol 12:12:1, vortexing and centrifuging at 14,000×g for 5 minutes. PCR reactions were applied to S-400 columns (GE Healthcare) and centrifuged for 2 minutes at 3,000× g. Purified PCR products were subsequently TOPO cloned into PCR8/GW/TOPO and positive clones selected for on LB/Spec plates. Purified plasmid DNA was sequenced in both directions using M13 forward and reverse primers. In total, twelve Prototheca strains were selected to have their 23S rRNA DNA sequenced and the sequences are listed in the Sequence Listing. A summary of the strains and Sequence Listing Numbers is included below. The sequences were analyzed for overall divergence from the UTEX 1435 (SEQ ID NO: 5) sequence. Two pairs emerged (UTEX 329/UTEX 1533 and UTEX 329/UTEX 1440) as the most divergent. In both cases, pairwise alignment resulted in 75.0% pairwise sequence identity. The percent sequence identity to UTEX 1435 is also included below:

| Species | Strain | % nt identity | SEQ ID NO. |
|---|---|---|---|
| Prototheca kruegani | UTEX 329 | 75.2 | SEQ ID NO: 1 |
| Prototheca wickerhamii | UTEX 1440 | 99 | SEQ ID NO: 2 |
| Prototheca stagnora | UTEX 1442 | 75.7 | SEQ ID NO: 3 |
| Prototheca moriformis | UTEX 288 | 75.4 | SEQ ID NO: 4 |
| Prototheca moriformis | UTEX 1439; 1441; 1435; 1437 | 100 | SEQ ID NO: 5 |
| Prototheca wikerhamii | UTEX 1533 | 99.8 | SEQ ID NO: 6 |
| Prototheca moriformis | UTEX 1434 | 75.9 | SEQ ID NO: 7 |
| Prototheca zopfii | UTEX 1438 | 75.7 | SEQ ID NO: 8 |
| Prototheca moriformis | UTEX 1436 | 88.9 | SEQ ID NO: 9 |

Lipid samples from a subset of the above-listed strains were analyzed for fatty acid profile using HPLC. Results are shown below in Table 4.

TABLE 4

Diversity of fatty acid chains in Prototheca species

| Strain | C14:0 | C16:0 | C16:1 | C18:0 | C18:1 | C18:2 | C18:3 | C20:0 | C20:1 |
|---|---|---|---|---|---|---|---|---|---|
| UTEX 327 | 0 | 12.01 | 0 | 0 | 50.33 | 17.14 | 0 | 0 | 0 |
| UTEX 1441 | 1.41 | 29.44 | 0.70 | 3.05 | 57.72 | 12.37 | 0.97 | 0.33 | 0 |
| UTEX 1435 | 1.09 | 25.77 | 0 | 2.75 | 54.01 | 11.90 | 2.44 | 0 | 0 |

Oil extracted from Prototheca moriformis UTEX 1435 (via solvent extraction or using an expeller press) was analyzed for carotenoids, chlorophyll, tocopherols, other sterols and tocotrienols. The results are summarized below in Table 5.

TABLE 5

Carotenoid, chlorophyll, tocopherol/sterols and tocotrienol analysis in oil extracted from Prototheca moriformis (UTEX 1435).

| | Pressed oil (mcg/ml) | Solvent extracted oil (mcg/ml) |
|---|---|---|
| cis-Lutein | 0.041 | 0.042 |
| trans-Lutein | 0.140 | 0.112 |
| trans-Zeaxanthin | 0.045 | 0.039 |
| cis-Zeaxanthin | 0.007 | 0.013 |
| t-alpha-Crytoxanthin | 0.007 | 0.010 |
| t-beta-Crytoxanthin | 0.009 | 0.010 |
| t-alpha-Carotene | 0.003 | 0.001 |

TABLE 5-continued

Carotenoid, chlorophyll, tocopherol/sterols and tocotrienol analysis in oil extracted from *Prototheca moriformis* (UTEX 1435).

| | | |
|---|---|---|
| c-alpha-Carotene | none detected | none detected |
| t-beta-Carotene | 0.010 | 0.009 |
| 9-cis-beta-Carotene | 0.004 | 0.002 |
| Lycopene | none detected | none detected |
| Total Carotenoids | 0.267 | 0.238 |
| Chlorophyll | <0.01 mg/kg | <0.01 mg/kg |

Tocopherols and Sterols

| | Pressed oil (mg/100 g) | Solvent extracted oil (mg/100 g) |
|---|---|---|
| gamma Tocopherol | 0.49 | 0.49 |
| Campesterol | 6.09 | 6.05 |
| Stigmasterol | 47.6 | 47.8 |
| Beta-sitosterol | 11.6 | 11.5 |
| Other sterols | 445 | 446 |

Tocotrienols

| | Pressed oil (mg/g) | Solvent extracted oil (mg/g) |
|---|---|---|
| alpha Tocotrienol | 0.26 | 0.26 |
| beta Tocotrienol | <0.01 | <0.01 |
| gamma Tocotrienol | 0.10 | 0.10 |
| detal Tocotrienol | <0.01 | <0.01 |
| Total Tocotrienols | 0.36 | 0.36 |

Oil extracted from *Prototheca moriformis*, from four separate lots, was refined and bleached using standard vegetable oil processing methods. Briefly, crude oil extracted from *Prototheca moriformis* was clarified in a horizontal decanter, where the solids were separated from the oil. The clarified oil was then transferred to a tank with citric acid and water and left to settle for approximately 24 hours. After 24 hours, the mixture in the tank formed 2 separate layers. The bottom layer was composed of water and gums that were then removed by decantation prior to transferring the degummed oil into a bleaching tank. The oil was then heated along with another dose of citric acid. Bleaching clay was then added to the bleaching tank and the mixture was further heated under vacuum in order to evaporate off any water that was present. The mixture was then pumped through a leaf filter in order to remove the bleaching clay. The filtered oil was then passed through a final 5 μm polishing filter and then collected for storage until use. The refined and bleached (RB) oil was then analyzed for carotenoids, chlorophyll, sterols, tocotrienols and tocopherols. The results of these analyses are summarized in Table 6 below. "Nd" denotes none detected and the sensitivity of detection is listed below:

Sensitivity of Detection
Carotenoids (mcg/g) nd=<0.003 mcg/g
Chlorophyll (mcg/g) nd=<0.03 mcg/g
Sterols (%) nd=0.25%
Tocopherols (mcg/g); nd=3 mcg/g

TABLE 6

Carotenoid, chlorophyll, sterols, tocotrienols and tocopherol analysis from refined and bleached *Prototheca moriformis* oil.

| | Lot A | Lot B | Lot C | Lot D |
|---|---|---|---|---|
| Carotenoids (mcg/g) | | | | |
| Lutein | 0.025 | 0.003 | nd | 0.039 |
| Zeaxanthin | nd | nd | nd | nd |
| cis-Lutein/Zeaxanthin | nd | nd | nd | nd |
| trans-alpha-Cryptoxanthin | nd | nd | nd | nd |
| trans-beta-Cryptoxanthin | nd | nd | nd | nd |
| trans-alpha-Carotene | nd | nd | nd | nd |
| cis-alpha-Carotene | nd | nd | nd | nd |
| trans-beta-Carotene | nd | nd | nd | nd |
| cis-beta-Carotene | nd | nd | nd | nd |
| Lycopene | nd | nd | nd | nd |
| Unidentified | 0.219 | 0.066 | 0.050 | 0.026 |
| Total Carotenoids | 0.244 | 0.069 | 0.050 | 0.065 |
| Chlorophyll (mcg/g) | | | | |
| Chlorophyll A | 0.268 | 0.136 | 0.045 | 0.166 |
| Chlorophyll B | nd | nd | nd | nd |
| Total Chlorophyll | 0.268 | 0.136 | 0.045 | 0.166 |
| Sterols (%) | | | | |
| Brassicasterol | nd | nd | nd | nd |
| Campesterol | nd | nd | nd | nd |
| Stigmasterol | nd | nd | nd | nd |
| beta-Sitosterol | nd | nd | nd | nd |
| Total Sterols | nd | nd | nd | nd |
| Tocopherols (mcg/g) | | | | |
| alpha-Tocopherol | 23.9 | 22.8 | 12.5 | 8.2 |
| beta-Tocopherol | 3.72 | nd | nd | nd |
| gamma-Tocopherol | 164 | 85.3 | 43.1 | 38.3 |
| delta-Tocopherol | 70.1 | 31.1 | 18.1 | 14.3 |
| Total Tocopherols | 262 | 139.2 | 73.7 | 60.8 |
| Tocotrienols (mcg/g) | | | | |
| alpha-Tocotrienol | 190 | 225 | 253 | 239 |
| beta-Tocotrienol | nd | nd | nd | nd |
| gamma-Tocotrienol | 47.3 | 60.4 | 54.8 | 60.9 |
| delta-Tocotrienol | 12.3 | 16.1 | 17.5 | 15.2 |
| Total Tocotrienols | 250 | 302 | 325 | 315 |

The same four lots of *Prototheca moriformis* oil was also analyzed for trace elements and the results are summarized below in Table 7.

TABLE 7

Elemental analysis of refined and bleached *Prototheca moriformis* oil.

| | Lot A | Lot B | Lot C | Lot D |
|---|---|---|---|---|
| Elemental Analysis (ppm) | | | | |
| Calcium | 0.08 | 0.07 | <0.04 | 0.07 |
| Phosphorous | <0.2 | 0.38 | <0.2 | 0.33 |
| Sodium | <0.5 | 0.55 | <0.5 | <0.5 |
| Potassium | 1.02 | 1.68 | <0.5 | 0.94 |
| Magnesium | <0.04 | <0.04 | <0.04 | 0.07 |
| Manganese | <0.05 | <0.05 | <0.05 | <0.05 |
| Iron | <0.02 | <0.02 | <0.02 | <0.02 |
| Zinc | <0.02 | <0.02 | <0.02 | <0.02 |
| Copper | <0.05 | <0.05 | <0.05 | <0.05 |
| Sulfur | 2.55 | 4.45 | 2.36 | 4.55 |
| Lead | <0.2 | <0.2 | <0.2 | <0.2 |
| Silicon | 0.37 | 0.41 | 0.26 | 0.26 |
| Nickel | <0.2 | <0.2 | <0.2 | <0.2 |
| Organic chloride | <1.0 | <1.0 | <1.0 | 2.2 |
| Inorganic chloride | <1.0 | <1.0 | <1.0 | <1.0 |
| Nitrogen | 4.4 | 7.8 | 4.2 | 6.9 |
| Lithium | <0.02 | <0.02 | <0.02 | <0.02 |
| Boron | 0.07 | 0.36 | 0.09 | 0.38 |
| Aluminum | — | <0.2 | <0.2 | <0.2 |
| Vanadium | <0.05 | <0.05 | <0.05 | <0.05 |

TABLE 7-continued

Elemental analysis of refined and bleached *Prototheca moriformis* oil.

| | Lot A | Lot B | Lot C | Lot D |
|---|---|---|---|---|
| Lovibond Color (°L) | | | | |
| Red | 5.0 | 4.3 | 3.2 | 5.0 |
| Yellow | 70.0 | 70.0 | 50.0 | 70.0 |
| Mono & Diglycerides by HPLC (%) | | | | |
| Diglycerides | 1.68 | 2.23 | 1.25 | 1.61 |
| Monoglycerides | 0.03 | 0.04 | 0.02 | 0.03 |
| Free fatty acids (FFA) | 1.02 | 1.72 | 0.86 | 0.83 |
| Soaps | 0 | 0 | 0 | |
| Oxidized and Polymerized Triglycerides | | | | |
| Oxidized Triglycerides (%) | 3.41 | 2.41 | 4.11 | 1.00 |
| Polymerized Triglycerides (%) | 1.19 | 0.45 | 0.66 | 0.31 |
| Peroxide Value (meq/kg) | 0.75 | 0.80 | 0.60 | 1.20 |
| p-Anisidine value (dimensionless) | 5.03 | 9.03 | 5.44 | 20.1 |
| Water and Other Impurities (%) | | | | |
| Karl Fisher Moisture | 0.8 | 0.12 | 0.07 | 0.18 |
| Total polar compounds | 5.02 | 6.28 | 4.54 | 5.23 |
| Unsaponificable matter | 0.92 | 1.07 | 0.72 | 1.04 |
| Insoluble impurities | <0.01 | <0.01 | 0.01 | <0.01 |
| Total oil (%) | | | | |
| Neutral oil | 98.8 | 98.2 | 99.0 | 98.9 |

Example 2

General Methods for Biolistic Transformation of *Prototheca*

Seashell Gold Microcarriers (550 nanometers) were prepared according to the protocol from manufacturer. Plasmid (20 μg) was mixed with 50 μl of binding buffer and 60 μl (30 mg) of S550d gold carriers and incubated in ice for 1 min. Precipitation buffer (100 μl) was added, and the mixture was incubated in ice for another 1 min. After vortexing, DNA-coated particles were pelleted by spinning at 10,000 rpm in an Eppendorf 5415C microfuge for 10 seconds. The gold pellet was washed once with 500 μl of cold 100% ethanol, pelleted by brief spinning in the microfuge, and resuspended with 50 μl of ice-cold ethanol. After a brief (1-2 sec) sonication, 10 μl of DNA-coated particles were immediately transferred to the carrier membrane.

*Prototheca* strains were grown in proteose medium (2 g/L yeast extract, 2.94 mM NaNO3, 0.17 mM CaCl2.2H2O, 0.3 mM MgSO4.7H2O, 0.4 mM K2HPO4, 1.28 mM KH2PO4, 0.43 mM NaCl) with 2% glucose on a gyratory shaker until it reaches a cell density of $2 \times 10^6$ cells/ml. The cells were harvested, washed once with sterile distilled water, and resuspended in 50 μl of medium. $1 \times 10^7$ cells were spread in the center third of a non-selective proteose media plate. The cells were bombarded with the PDS-1000/He Biolistic Particle Delivery system (Bio-Rad). Rupture disks (1350 psi) were used, and the plates are placed 6 cm below the screen/macrocarrier assembly. The cells were allowed to recover at 25° C. for 12-24 h. Upon recovery, the cells were scraped from the plates with a rubber spatula, mixed with 100 μl of medium and spread on plates containing the appropriate antibiotic selection. After 7-10 days of incubation at 25° C., colonies representing transformed cells were visible on the plates. Colonies were picked and spotted on selective (either antibiotic or carbon source) agar plates for a second round of selection.

Example 3

Fatty Acid Analysis by Fatty Acid Methyl Ester Detection

Lipid samples were prepared from dried biomass. 20-40 mg of dried biomass was resuspended in 2 mL of 5% $H_2SO_4$ in MeOH, and 200 ul of toluene containing an appropriate amount of a suitable internal standard (C19:0) was added. The mixture was sonicated briefly to disperse the biomass, then heated at 70-75° C. for 3.5 hours. 2 mL of heptane was added to extract the fatty acid methyl esters, followed by addition of 2 mL of 6% $K_2CO_3$ (aq) to neutralize the acid. The mixture was agitated vigorously, and a portion of the upper layer was transferred to a vial containing $Na_2SO_4$ (anhydrous) for gas chromatography analysis using standard FAME Example 4

Altering the Levels of Saturated Fatty Acids in the Microalgae *Prototheca Moriformis*

A. Decreasing Stearoyl ACP Desaturase and Delta 12 Fatty Acid Desaturase Expression by a Gene Knockout Approach As part of a genomics screen using a bioinformatics based approach based on cDNAs, Illumina transcriptome and Roche 454 sequencing of genomic DNA from *Prototheca moriformis* (UTEX 1435), two specific groups of genes involved in fatty acid desaturation were identified: stearoyl ACP desaturases (SAD) and delta 12 fatty acid desaturases (Δ12 FAD). Stearoyl ACP desaturase enzymes are part of the lipid synthesis pathway and they function to introduce double bonds into the fatty acyl chains, for example, the synthesis of C18:1 fatty acids from C18:0 fatty acids. Delta 12 fatty acid desaturases are also part of the lipid synthesis pathway and they function to introduce double bonds into already unsaturated fatty acids, for example, the synthesis of C18:2 fatty acids from C18:1 fatty acids. The genes encoding stearoyl ACP desaturases fell into two distinct families. Based on these results, three gene disruption constructs were designed to potentially disrupt multiple gene family members by targeting more highly conserved coding regions within each family of desaturase enzymes.

Three homologous recombination targeting constructs were designed using: (1) highly conserved portions of the coding sequence of delta 12 fatty acid desaturase (d12FAD) or FAD2 family members and (2) two constructs targeting each of the two distinct families of SAD (SAD1 and SAD2), each with conserved regions of the coding sequences from each family. This strategy would embed a selectable marker gene into these highly conserved coding regions (targeting multiple family members) rather than a classic gene replacement strategy where the homologous recombination would target flanking regions of the targeted gene.

All constructs were introduced into the cells by biolistic transformation using the methods described above and constructs were linearized before being shot into the cells. Transformants were selected on sucrose containing plates/media and changes in lipid profile were assayed using the above-described method. Relevant sequences from each of the three targeting constructs are listed below.

| Description | SEQ ID NO: |
|---|---|
| 5' sequence from coding region of d12FAD targeting construct | SEQ ID NO: 18 |
| 3' sequence from coding region of d12FAD targeting construct | SEQ ID NO: 19 |
| d12FAD targeting construct cDNA sequence | SEQ ID NO: 20 |

| Description | SEQ ID NO: |
| --- | --- |
| 5' sequence from coding region of SAD2A | SEQ ID NO: 21 |
| 3' sequence from coding region of SAD2A | SEQ ID NO: 22 |
| SAD2A targeting construct cDNA sequence | SEQ ID NO: 23 |
| 5' sequence from coding region os SAD2B | SEQ ID NO: 24 |
| 3' sequence from coding region of SAD2B | SEQ ID NO: 25 |
| SAD2B targeting construct cDNA sequence | SEQ ID NO: 26 |

Representative positive clones from transformations with each of the constructs were picked and the fatty acid profiles for these clones were determined. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic lines arising from transformation are shown in Table 8.

TABLE 8

| Fatty acid profiles of desaturase knockouts. | | | | |
| --- | --- | --- | --- | --- |
| Fatty Acid | d12FAD KO | SAD2A KO | SAD2B KO | wt UTEX 1435 |
| C8:0 | 0 | 0 | 0 | 0 |
| C10:0 | 0.01 | 0.01 | 0.01 | 0.01 |
| C12:0 | 0.03 | 0.03 | 0.03 | 0.03 |
| C14:0 | 1.08 | 0.985 | 0.795 | 1.46 |
| C16:0 | 24.42 | 25.335 | 23.66 | 29.87 |
| C18:0 | 6.85 | 12.89 | 19.555 | 3.345 |
| C18:1 | 58.35 | 47.865 | 43.115 | 54.09 |
| C18:2 | 7.33 | 10.27 | 9.83 | 9.1 |
| C18:3 alpha | 0.83 | 0.86 | 1 | 0.89 |
| C20:0 | 0.48 | 0.86 | 1.175 | 0.325 |

Each construct had a measurable impact on the desired class of fatty acid and in all three cases C18:0 levels increased markedly, particularly with the two SAD knockouts. Further comparison of multiple clones from the SAD knockouts indicated that the SAD2B knockout lines had significantly greater reductions in C18:1 fatty acids than the C18:1 fatty acid levels observed with the SAD2A knockout lines.

Additional Δ12 FAD knockouts were generated in a *Prototheca moriformis* background using the methods described above. In order to identify potential homologous of Δ12FADs, the following primers were used in order to amplify a genomic region encoding a putative FAD:

```
                    SEQ ID NO: 27
Primer 1    5'-TCACTTCATGCCGGCGGTCC-3'

SEQ ID NO: 28
Primer 2    5'- GCGCTCCTGCTTGGCTCGAA-3'
```

The sequences resulting from the genomic amplification of *Prototheca moriformis* genomic DNA using the above primers were highly similar, but indicated that multiple genes or alleles of Δ12FADs exist in *Prototheca*.

Based on this result, two gene disruption constructs were designed that sought to inactivate one or more Δ12FAD genes. The strategy would embed a sucrose invertase (suc2 from *S. cerevisiae*) cassette (SEQ ID NO: 29), thus conferring the ability to hydrolyze sucrose as a selectable marker, into highly conserved coding regions rather than use a classic gene replacement strategy. The first construct, termed pSZ1124, contained 5' and 3' genomic targeting sequences flanking a *C. reinhardtii* β-tubulin promoter (SEQ ID NO: 30) driving the expression of the *S. cerevisiae* suc2 gene (SEQ ID NO: 31) and a *Chlorella vulgaris* nitrate reductase 3'UTR (SEQ ID NO: 32). The second construct, termed pSZ1125, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR. The relevant sequences of the constructs are listed in the Sequence Listing:

| | |
| --- | --- |
| *S. cerevisiae* suc2 cassette | SEQ ID NO: 29 |
| pSZ1124 (FAD2B) 5' genomic targeting sequence | SEQ ID NO: 33 |
| pSZ1124 (FAD2B) 3' genomic targeting sequence | SEQ ID NO: 34 |
| pSZ1125 (FAD2C) 5' genomic targeting sequence | SEQ ID NO: 35 |
| pSZ1125 (FAD2C) 3' genomic targeting sequence | SEQ ID NO: 36 | pSZ1124 and pSZ1125 were each introduced into a *Prototheca moriformis* background. Positive clones were selected based on the ability to hydrolyze sucrose. Table 9 summarizes the fatty acid profiles (in Area %, generated using methods described above) obtained in two transgenic lines in which pSZ1124 and pSZ1125 targeting vectors were utilized.

TABLE 9

| Fatty acid profiles of Δ12 FAD knockouts | | | | | | | | | |
| --- | --- | --- | --- | --- | --- | --- | --- | --- | --- |
| | C10:0 | C12:0 | C14:0 | C16:0 | C16:1 | C18:0 | C18:1 | C18:2 | C18:3α |
| parent | 0.01 | 0.03 | 1.15 | 26.13 | 1.32 | 4.39 | 57.20 | 8.13 | 0.61 |
| FAD2B | 0.02 | 0.03 | 0.80 | 12.84 | 1.92 | 0.86 | 74.74 | 7.08 | 0.33 |
| FAD2C | 0.02 | 0.04 | 1.42 | 25.85 | 1.65 | 2.44 | 66.11 | 1.39 | 0.22 |

The transgenic containing the FAD2B (pSZ1124) construct gave a very interesting and unexpected result in fatty acid profile, in that the C18:2 levels, which would be expected to decrease, only decreased by about one area %. However, the C18:1 fatty acid levels increased significantly, almost exclusively at the expense of the C16:0 levels, which decreased significantly. The transgenic containing the FAD2C (pSZ1125) construct also gave a change in lipid profile: the levels of C18:2 are reduced significantly along with a corresponding increase in C18:1 levels.

B. RNA Hairpin Approach to Down-Regulation of Delta 12 Desaturase (FADC) in *Prototheca* Cells Vectors constructed to down-regulate FADc (delta 12 desaturase gene) gene expression by long hairpin RNAs were introduced into a *Prototheca moriformis* UTEX 1435 genetic background. The *Saccharomyces cerevisiae* suc2 sucrose invertase gene was utilized as a selectable marker, conferring the ability to grow on sucrose as a sole-carbon source to positive clones, and two types of constructs were used. The first type of construct utilized a portion of the first exon of the FADc coding region linked in cis to its first intron followed by a repeat unit of the first exon in reverse orientation. This type of construct was designed to form a hairpin when expressed as mRNA. Two constructs of this first type were created, one driven by the *Prototheca moriformis* Amt03 promoter (SEQ ID NO:37), termed pSZ1468, and a second driven by the *Chlamydomomas reinhardtii* β-tubulin promoter (SEQ ID NO:30), termed pSZ1469. The second type of construct utilized the large FADc exon 2 in the antisense orientation driven by either the *Prototheca moriformis* Amt03 promoter (SEQ ID NO:37), termed pSZ1470, or driven by the *Chlamydomomas reinhardtii* β-tubulin promoter (SEQ ID NO:30), termed pSZ1471. All four constructs had a *S. cerevisiae* suc2 sucrose invertase cassette (SEQ ID NO:29) and a 5' (SEQ ID NO:38) and 3' (SEQ ID NO:39) homologous recombination targeting sequences (flanking the construct) to the 6S genomic region for integration into the nuclear genome. Sequences of the FADc portions of each long hairpin RNA construct along with the relevant portions of each construct are listed in the Sequence Listing as:

| Description | SEQ ID NO: |
| --- | --- |
| pSZ1468 FADc RNA hairpin cassette | SEQ ID NO: 40 |
| Relevant portions of the pSZ1468 construct | SEQ ID NO: 41 |
| pSZ1469 FADc RNA hairpin cassette | SEQ ID NO: 42 |
| Relevant portions of the pSZ1469 construct | SEQ ID NO: 43 |
| pSZ1470 FADc exon 2 RNA hairpin cassette | SEQ ID NO: 44 |
| Relevant portions of the pSZ1470 construct | SEQ ID NO: 45 |
| pSZ1471 FADc exon 2 RNA hairpin cassette | SEQ ID NO: 46 |
| Relevant portions of the pSZ1471 construct | SEQ ID NO: 47 |

Each of the four constructs was transformed into a *Prototheca moriformis* (UTEX 1435) background and positive clones were screened using plates with sucrose as the sole carbon source. Positive clones were picked from each transformation and a subset were selected to determine the impact of the hairpin and antisense cassettes contained in pSZ1468, pSZ1469, pSZ1470 and pSZ1471 on fatty acid profiles. The selected clones from each transformation were grown under lipid producing conditions and the fatty acid profiles were determined using direct transesterification methods as described above. Representative fatty acid profiles from each of the transformations are summarized below in Table 10. Wildtype 1 and 2 cells were untransformed *Prototheca moriformis* (UTEX 1435) cells that were run with each of the transformants as a negative control.

TABLE 10

Fatty acid profiles of *Prototheca moriformis* cells containing long hairpin RNA constructs to down-regulate the expression of delta 12 desaturase gene (FADc).

| Strain | C10:0 | C12:0 | C14:0 | C16:0 | C18:0 | C18:1 | C18:2 |
| --- | --- | --- | --- | --- | --- | --- | --- |
| wildtype 1 | 0.01 | 0.03 | 1.20 | 27.08 | 4.01 | 57.58 | 7.81 |
| pSZ1468 clone A | 0.01 | 0.04 | 1.33 | 25.95 | 3.68 | 65.60 | 1.25 |
| pSZ1468 clone B | 0.01 | 0.03 | 1.18 | 23.43 | 2.84 | 65.32 | 4.91 |
| pSZ1468 clone C | 0.01 | 0.04 | 1.34 | 23.18 | 4.27 | 63.65 | 5.17 |
| pSZ1468 clone D | 0.01 | 0.03 | 1.24 | 23.00 | 3.85 | 61.92 | 7.62 |
| pSZ1470 clone A | 0.01 | 0.03 | 1.23 | 24.79 | 4.33 | 58.43 | 8.92 |
| pSZ1470 clone B | 0.01 | 0.03 | 1.26 | 24.91 | 4.14 | 57.59 | 9.64 |
| pSZ1470 clone C | 0.01 | 0.03 | 1.21 | 23.35 | 4.75 | 58.52 | 9.70 |
| wildtype 2 | 0.01 | 0.03 | 0.98 | 24.65 | 3.68 | 62.48 | 6.26 |
| pSZ1469 clone A | 0.01 | 0.03 | 1.05 | 21.74 | 2.71 | 71.33 | 1.22 |
| pSZ1469 clone B | 0.01 | 0.03 | 1.01 | 22.60 | 2.98 | 70.19 | 1.27 |
| pSZ1469 clone C | 0.01 | 0.03 | 1.03 | 19.82 | 2.38 | 72.95 | 1.82 |
| pSZ1469 clone D | 0.01 | 0.03 | 1.03 | 20.54 | 2.66 | 70.96 | 2.71 |
| pSZ1471 clone A | 0.01 | 0.03 | 1.03 | 18.42 | 2.63 | 66.94 | 8.55 |
| pSZ1471 clone B | 0.01 | 0.03 | 0.94 | 18.61 | 2.58 | 67.13 | 8.66 |
| pSZ1471 clone C | 0.01 | 0.03 | 1.00 | 18.31 | 2.46 | 67.41 | 8.71 |
| pSZ1471 clone D | 0.01 | 0.03 | 0.93 | 18.82 | 2.54 | 66.84 | 8.77 |

The above results show that the hairpin constructs pSZ1468 and pSZ1469 showed expected phenotypes: a reduction in C18:2 fatty acid levels and an increase in C18:1 fatty acid levels as compared to wildtype1 and wildtype 2, respectively. The antisense constructs, pSZ1470 and pSZ1471 did not result in a decrease in C18:2 fatty acid levels but instead showed a slight increase when compared to wildtype 1 and wildtype 2, respectively and a slight decrease in C16:0 fatty acid levels.

Example 5

Engineered Microalgae with Altered Fatty Acid Profiles

As described above, integration of heterologous genes to attenuate specific endogenous lipid pathway genes, through knockout or knockdown, in *Prototheca* species can alter fatty acid profiles. Plasmid constructs (listed in Table 11) were created to assess whether the fatty acid profile of a host cell may be affected as a result of a knockout an endogenous fatty acyl-ACP thioesterase gene, FATA1.

A classically mutagenized derivative of *Protheca moriformis* UTEX 1435, Strain J, was transformed with one of the following plasmid constructs in Table 11 using the methods of Example 2. Each construct contained a region for integration into the nuclear genome to interrupt the endogenous FATA1 gene and a *S. cerevisiae* suc2 sucrose invertase coding region under the control of *C. reinhardtii* β-tubulin promoter/5'UTR (SEQ ID NO: 30) and *Chlorella vulgaris* nitrate reductase 3' UTR (SEQ ID NO: 32). This *S. cerevisiae* suc2 expression cassette is listed as SEQ ID NO: 29 and served as a selection marker. All protein coding regions were codon optimized to reflect the codon bias inherent in *Prototheca moriformis* UTEX 1435 (see Table 2) nuclear genes. Relevant sequences for the targeting regions for the FATA1 gene used for nuclear genome integration are shown below.

| Description | SEQ ID NO: |
|---|---|
| 5' sequence for integration into FATA1 locus | SEQ ID NO: 48 |
| 3' sequence for integration into FATA1 locus | SEQ ID NO: 49 |

TABLE 11

Plasmid constructs used to transform *Prototheca moriformis* (UTEX 1435) STRAIN J.

| Plasmid Construct | Relevant Sequence Elements | SEQ ID NO: |
|---|---|---|
| pSZ1883 | FATA1-CrbTub_yInv_nr-FATA1 | SEQ ID NO: 50 |
| pSZ1925 | FATA1-CrbTub_yInv_nr::amt03_CwTE2_nr-FATA1 | SEQ ID NO: 51 |

To introduce the *Cuphea wrightii* ACP-thioesterase 2 (CwFatB2) gene (Accession No: U56104) into STRAIN J at the FATA1-1 locus, a construct was generated to express the protein coding region of the CwFatB2 gene under the control of the *Prototheca moriformis* Amt03 promoter/5'UTR (SEQ ID NO: 37) and *C. vulgaris* nitrate reductase 3'UTR (SEQ ID NO: 32). Relevant portions of this construct are provided in the Sequence Listing as SEQ ID NO: 51. The codon-optimized cDNA sequences and amino acid sequences of the *Cuphea wrightii* FatB2 thioesterase are listed in the Sequence Listing as SEQ ID NO: 52 and SEQ ID NO: 53, respectively.

Upon transformation of FATA1-CrbTub_yInv_nr-FATA1 into STRAIN J, primary transformants were clonally purified and grown under standard lipid production conditions at pH 5.0 similar to the conditions as disclosed in Example 1. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic lines arising from transformation with pSZ1883 into Strain J are shown in Table 12.

TABLE 12

Fatty acid profiles of *Prototheca moriformis* cells containing a selectable marker to disrupt an endogenous FATA1 allele.

| Transformation | % C14:0 | % C16:0 | % C18:0 | % C18:1 | % C18:2 |
|---|---|---|---|---|---|
| Wildtype | 1.23 | 25.68 | 2.83 | 60.54 | 7.52 |
| Transformant 1 | 0.86 | 16.95 | 1.75 | 68.44 | 9.78 |
| Transformant 2 | 0.85 | 17.33 | 1.71 | 68.57 | 9.31 |
| Transformant 3 | 0.82 | 17.40 | 1.78 | 68.55 | 9.22 |
| Transformant 4 | 0.84 | 17.43 | 1.78 | 68.25 | 9.53 |
| Transformant 5 | 0.75 | 17.64 | 2.02 | 69.02 | 8.61 |

These results show that ablation of the host's endogenous FATA1-1 allele alters the fatty acid profile of the engineered microalgae. The impact of targeting a selectable marker to the endogenous FATA1 allele is a clear diminution of C16:0 fatty acid production with an increase in C18:1 fatty acid production.

Upon transformation of FATA1-CrbTub_yInv_nr::amt03_CwTE2_nr-FATA1 into STRAIN J, primary transformants were clonally purified and grown under standard lipid production conditions at pH 7.0 with different carbon sources provided to a total concentration of 40 g/L. The sucrose concentration was 40 g/L. Where only glucose was used as the carbon source, glucose was provided at 40 g/L. Where glucose and fructose was used as the carbon source, gluces was provided at 20 g/L and fructose was provided at 20 g/L. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic line arising from transformation with pSZ1925 into Strain J are shown in Table 13. The resulting fatty acid profiles are listed in Table 13.

TABLE 13

Fatty acid profiles of *Prototheca moriformis* cells containing a selectable marker and an exogenous thioesterase to disrupt an endogenous FATA1 allele.

| | Transformant | Carbon source | % C10:0 | % C12:0 | % C14:0 | % C16:0 | % C18:0 | % C18:1 | % C18:2 |
|---|---|---|---|---|---|---|---|---|---|
| Strain J | Wildtype | Glucose | 0.01 | 0.04 | 1.38 | 28.83 | 3.00 | 56.05 | 8.21 |
| | Wildtype | Glucose | 0.01 | 0.04 | 1.50 | 29.38 | 3.00 | 55.29 | 8.23 |
| | Wildtype | Glucose/Fructose | 0.01 | 0.05 | 1.48 | 28.58 | 3.20 | 57.14 | 7.27 |
| | Wildtype | Glucose/Fructose | 0.01 | 0.04 | 1.54 | 29.05 | 3.23 | 56.47 | 7.32 |

TABLE 13-continued

Fatty acid profiles of Prototheca moriformis cells containing a selectable marker and an exogenous thioesterase to disrupt an endogenous FATA1 allele.

| | Transformant | Carbon source | % C10:0 | % C12:0 | % C14:0 | % C16:0 | % C18:0 | % C18:1 | % C18:2 |
|---|---|---|---|---|---|---|---|---|---|
| >2 copies | 1 | Glucose/Fructose | 4.29 | 19.98 | 9.17 | 20.68 | 3.47 | 34.38 | 6.37 |
| | 2 | Glucose/Fructose | 3.11 | 16.17 | 9.91 | 15.97 | 1.57 | 45.72 | 5.81 |
| | 3 | Sucrose | 4.84 | 24.22 | 11.56 | 19.48 | 2.67 | 29.56 | 6.02 |
| | 4 | Sucrose | 3.24 | 16.67 | 10.39 | 16.34 | 1.43 | 44.41 | 6.00 |
| 1-2 copies | 1 | Glucose/Fructose | 0.18 | 1.64 | 1.85 | 14.43 | 2.12 | 70.30 | 7.63 |
| | 2 | Glucose/Fructose | 0.18 | 1.56 | 1.74 | 13.56 | 2.25 | 71.04 | 7.72 |
| | 3 | Sucrose | 0.19 | 1.69 | 1.89 | 13.79 | 3.15 | 69.97 | 7.68 |
| | 4 | Sucrose | 0.15 | 1.26 | 1.49 | 13.44 | 2.73 | 71.46 | 7.77 |

Concordant with targeting a selectable marker alone to the host's FATA1-1allele, integration of a selectable marker concomitant with an exogenous thioesterase alters the fatty acid profile of the engineered microalgae. As above, targeting an exogenous gene to the FATA1-1 allele results in a clear diminution of C16:0 fatty acid production. The additional expression of the CwTE2 thioesterase at the FATA1-1 locus also impacts mid chain fatty acids and C18:1 fatty acid production to an extent that is dependent upon the level of exogenous thioesterase activity present in the transformants analyzed. Genes bordered by repeat units such as the *C. vulgaris* nitrate reductase 3' UTR in constructs such as FATA1-CrbTub_yInv_nr::amt03_CwTE2_nr-FATA1, may be amplified upon integration in the host genome. There is good concordance between copy number of the amplified transgene at the target integration site and thioesterase levels as revealed either by impacts on fatty acid profiles or recombinant protein accumulation as assessed by western blotting.

Transgenic lines in which the CwTE2 gene has undergone amplification show a marked increase in mid chain (C10:0-C14:0) fatty acids and a concurrent decrease in C18:1 fatty acids. In contrast, those transformants in which CwTE2 has undergone little or no amplification (likely 1-2 copies) are consistent with lower expression of the exogenous thioesterase, resulting in a slight increase in mid chain fatty acids and a far greater impact on the increase of C18:1 fatty acids.

Collectively, these data show that ablation of the host's endogenous FATA1-1 allele alters the lipid profile of the engineered microalgae.

Example 6

Altering Fatty Acid Profiles of Microalgae through Overexpression of a *Prototheca* Lipid Biosynthesis Gene As described above, the β-ketoacyl-ACP synthase II (KASII) catalyzes the 2-carbon extension of C16:0-ACP to C18:0-ACP during fatty acid biosynthesis. It is an important lipid biosynthesis enzyme in establishing the fatty acid profile of the host organism and is critical for stearate and oleate production. Plasmid constructs were created to assess whether the fatty acid profile of a host cell may be affected as a result of expression of a KASII gene. Sources of KASII gene sequences were selected from *Prototheca moriformis* UTEX 1435 or from higher plants (*Glycine max, Helianthus annus*, or *Ricinus communis*).

A classically mutagenized derivative of *Protheca moriformis* UTEX 1435, STRAIN J, was transformed individually with one of the following plasmid constructs in Table 14 using the methods of Example 2. Each construct contained a region for integration into the nuclear genome at the 6S locus and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 29 and served as a selection marker. For each construct, the KASII coding region was under the control of the *Prototheca moriformis* Amt03 promoter/5'UTR (SEQ ID NO: 37) and *C. vulgaris* nitrate reductase 3'UTR (SEQ ID NO: 32). The native transit peptide of each KASII enzyme was replaced with the *Chlorella protothecoides* stearoyl-ACP desaturase transit peptide (SEQ ID NO: 54). All protein coding regions were codon optimized to reflect the codon bias inherent in *Prototheca moriformis* UTEX 1435 nuclear genes (see Table 2).

Relevant sequences for the targeting regions to the 6S locus for nuclear genome integration are shown below.

| Description | SEQ ID NO: |
|---|---|
| 5' sequence for integration into 6S locus | SEQ ID NO: 38 |
| 3' sequence for integration into 6S locus | SEQ ID NO: 39 |

TABLE 14

Plasmid constructs used to transform *Protheca moriformis* (UTEX 1435) STRAIN J.

| Plasmid Construct | Source of KASII enzyme | Sequence Elements | SEQ ID. NO: |
|---|---|---|---|
| pSZ1747 | *Glycine max* | 6S::β-tub:suc2:nr::Amt03:S106SAD:GlmKASII:nr::6S | SEQ ID NO: 55 |
| pSZ1750 | *Helianthus annuus* | 6S::β-tub:suc2:nr::Amt03:S106SAD:HaKASII:nr::6S | SEQ ID NO: 56 |
| pSZ1754 | *Ricinus communis* | 6S::β-tub:suc2:nr::Amt03:S106SAD:RcKASII:nr::6S | SEQ ID NO: 57 |
| pSZ2041 | *Protheca moriformis* | 6S::β-tub:suc2:nr::Amt03:S106SAD:PmKASII:nr::6S | SEQ ID NO: 58 |

The relevant nucleotide sequence of the construct 6S::β-tub:suc2:nr::Amt03:S106SAD:PmKASII:nr::6S is provided in the sequence listings as SEQ ID. NO: 58. The codon-optimized sequence of PmKASII comprising a *Chlorella protothecoides* S106 stearoyl-ACP desaturase transit peptide is provided the sequence listings as SEQ ID. NO: 105. SEQ ID NO: 106 provides the protein translation of SEQ ID NO. 105.

Upon individual transformation of each plasmid construct into Strain J, positive clones were screened on plates with sucrose as the sole carbon source. As in the previous examples, primary transformants were clonally purified and grown under standard lipid production conditions. Here, transformants were cultivated at pH 7 and lipid samples were prepared from dried biomass from each transformant as described above. Fatty acid profiles (expressed as Area %) of several positive transformants as compared to a wildtype negative control are summarized for each plasmid construct in Table 15 below.

TABLE 15

Fatty acid profiles of *Prototheca moriformis* cells engineered to overexpress KAS II genes.

| Plasmid Construct | KASII Source | Transformant | % C14:0 | % C16:0 | % C18:0 | % C18:1 | % C18:2 |
|---|---|---|---|---|---|---|---|
| None | no over-expression | 1 | 1.36 | 28.69 | 2.92 | 56.36 | 8.16 |
| | | 2 | 1.35 | 28.13 | 3.57 | 55.63 | 8.79 |
| | | 3 | 1.22 | 25.74 | 2.82 | 60.6 | 7.31 |
| | | 4 | 1.22 | 25.74 | 2.82 | 60.6 | 7.31 |
| pSZ1747 | Glm | 1 | 2.23 | 25.34 | 2.69 | 57.35 | 9.53 |
| | | 2 | 2.18 | 25.46 | 2.74 | 57.35 | 9.46 |
| | | 3 | 2.18 | 25.33 | 2.89 | 57.34 | 9.5 |
| | | 4 | 2.2 | 25.69 | 2.66 | 57.28 | 9.43 |
| | | 5 | 2.17 | 25.38 | 3.03 | 56.99 | 9.72 |
| pSZ1750 | Ha | 1 | 2.43 | 26.82 | 2.72 | 55.17 | 9.87 |
| | | 2 | 2.44 | 27.14 | 2.62 | 54.89 | 9.81 |
| | | 3 | 2.61 | 26.9 | 2.67 | 54.43 | 10.25 |
| | | 4 | 1.96 | 30.32 | 2.87 | 53.87 | 8.26 |
| | | 5 | 2.55 | 27.64 | 2.98 | 53.82 | 10.07 |
| pSZ1754 | Rc | 1 | 1.84 | 24.41 | 2.89 | 59.26 | 9.08 |
| | | 2 | 1.3 | 25.04 | 2.81 | 58.75 | 9.65 |
| | | 3 | 1.27 | 25.98 | 2.76 | 58.33 | 9.22 |
| | | 4 | 1.95 | 25.34 | 2.77 | 58.15 | 9.22 |
| | | 5 | 1.3 | 26.53 | 2.75 | 57.87 | 9.09 |
| pSZ2041 | Pm | 1 | 1.63 | 11.93 | 3.62 | 70.95 | 9.64 |
| | | 2 | 1.85 | 11.63 | 3.34 | 69.88 | 10.93 |
| | | 3 | 1.84 | 12.01 | 3.81 | 69.56 | 10.45 |
| | | 4 | 1.63 | 14.22 | 3.72 | 68.86 | 9.6 |
| | | 5 | 1.67 | 15.04 | 3.05 | 68.63 | 9.24 |

The data presented in Table 15 show that none of the higher plant KASII genes effected a change in the fatty acid profile of the transformed microalgal cells. Additional plasmid constructs expressing KASII genes from higher plants driven by promoters other than the *Prototheca* Amt03 promoter also failed to alter fatty acid profiles in transformed cells. In stark contrast, a clear diminution of C16:0 chain lengths with a concomitant increase in C18:1 length fatty acids was observed upon overexpression of the *Prototheca moriformis* KASII gene codon optimized using the codon frequency denoted in Table 2. Similar fatty acid profile changes were observed upon transformation of constructs expressing the PmKASII gene driven by a β-tublin promoter.

These results show that exogenous expression of a *Prototheca* lipid biosynthesis gene can alter the fatty acid profile of genetically engineered microalgae.

Example 7

Characteristics of Processed Oil Produced from Engineered Microorganisms

Methods and effects of transforming *Prototheca moriformis* (UTEX 1435) with transformation vector pSZ1500 (SEQ ID NO: 137) have been previously described in PCT Application Nos. PCT/US2011/038463, PCT/US2011/038464, and PCT/US2012/023696.

A classically mutagenized (for higher oil production) derivative of *Protheca moriformis* (UTEX 1435), Strain A, was transformed with pSZ1500 according to biolistic transformation methods as described in herein and in PCT/US2009/066141, PCT/US2009/066142, PCT/US2011/038463, PCT/US2011/038464, and PCT/US2012/023696. pSZ1500 comprised nucleotide sequence of the *Carthamus tinctorius* oleyl-thioesterase (CtOTE) gene, codon-optimized for expression in *P. moriformis* UTEX 1435. The pSZ1500 expression construct included 5' (SEQ ID NO: 138) and 3' (SEQ ID NO: 139) homologous recombination targeting sequences (flanking the construct) to the FADc genomic region for integration into the nuclear genome and a *S. cerevisiae* suc2 sucrose invertase coding region under the control of *C. reinhardtii* β-tubulin promoter/5'UTR (SEQ ID NO: 5) and *Chlorella vulgaris* nitrate reductase 3' UTR (SEQ ID NO: 126). This *S. cerevisiae* suc2 expression cassette is listed as SEQ ID NO: 127 and served as a selection marker. The CtOTE coding region was under the control of the *P. moriformis* Amt03 promoter/5'UTR (SEQ ID NO: 128) and *C. vulgaris* nitrate reductase 3'UTR, and the native transit peptide was replaced with the *C. protothecoides* stearoyl-ACP desaturase transit peptide (SEQ ID NO: 129). The protein coding regions of CtOTE and suc2 were codon optimized to reflect the codon bias inherent in *P. moriformis* UTEX 1435 nuclear genes as described in PCT/US2009/066141, PCT/US2009/066142, PCT/US2011/038463, PCT/US2011/038464, and PCT/US2012/023696.

Primary pSZ1500 transformants of Strain A were selected on agar plates containing sucrose as a sole carbon source, clonally purified, and a single engineered line, Strain D was selected for analysis. Strain D was grown as described in PCT/US2009/066141, PCT/US2009/066142, PCT/US2011/038463, PCT/US2011/038464, and PCT/US2012/023696. Hexane extraction of the oil from the generated biomass was then performed using standard methods, and the resulting triglyceride oil was determined to be free of residual hexane. Other methods of extraction of oil from microalgae using an expeller press are described in PCT Application No. PCT/US2010/031108 and are hereby incorporated by reference.

Different lots of oil extracted from biomass of Strain D were refined, bleached, and deodorized using standard vegetable oil processing methods. These procedures generated oil samples RBD437, RBD469, RBD501, RBD 502, RBD503, and RBD529, which were subjected to analytical testing protocols according to methods defined through the American Oil Chemists' Society, the American Society for Testing and Materials, and the International Organization for Standardization. The results of these analyses are summarized below in Tables 16-21.

TABLE 16

Analytical results for oil sample RBD469.

| Method Number | Test Description | Results | Units |
|---|---|---|---|
| AOCS Ca 3a-46 | Insoluble impurities | <0.01 | % |
| AOCS Ca 5a-40 | Free Fatty Acids (Oleic) | 0.02 | % |
| AOCS Ca 5a-40 | Acid Value | 0.04 | mg KOH/g |
| AOCS CA 9f-57 | Neutral oil | 98.9 | % |
| D97 | Cloud Point | −15 | deg C. |
| D97 | Pour Point | −18 | deg C. |
| | Karl Fischer Moisture | 0.01 | % |
| AOCS Cc 13d-55 (modified) | Chlorophyll | <0.01 | ppm |
| | Iodine Value | 78.3 | g I$_2$/100 g |
| AOCS Cd 8b-90 | Peroxide Value | 0.31 | meq/kg |
| ISO 6885 | p-Anisidine Value | 0.65 | |
| AOCS Cc 18-80 | Dropping Melting point (Mettler) | 6.2 | deg C. |
| AOCS Cd 11d-96 | Tricylglicerides | 98.6 | % |
| AOCS Cd 11d-96 | Monoglyceride | <0.01 | % |
| AOCS Cd 11d-96 | Diglicerides | 0.68 | % |
| AOCS Cd 20-91 | Total Polar Compounds | 2.62 | % |
| IUPAC, 2.507 and 2.508 | Oxidized & Polymerized Tricylglicerides | 17.62 | % |
| AOCS Cc 9b-55 | Flash Point | 244 | deg C. |
| AOCS Cc 9a-48 | Smoke Point | 232 | deg C. |
| AOCS Cd 12b-92 | Oxidataive Stability Index Rancimat (110° C.) | 31.6 | hours |
| AOCS Ca 6a-40 | Unsaponified Matter | 2.28 | % |

RBD469 oil was analyzed for trace element content, solid fat content, and Lovibond color according to AOCS methods. Results of these analyses are presented below in Table 17, Table 18, and Table 19.

TABLE 17

ICP Elemental Analysis of RBD469 oil.

| Method Number | Test Description | Results in ppm |
|---|---|---|
| AOCS Ca 20-99 and AOCS Ca 17-01 (modified) | Phosphorus | 1.09 |
| | Calcium | 0.1 |
| | Magnesium | 0.04 |
| | Iron | <0.02 |
| | Sulfur | 28.8 |
| | Copper | <0.05 |
| | Potassium | <0.50 |
| | Sodium | <0.50 |
| | Silicon | 0.51 |
| | Boron | 0.06 |
| | Aluminum | <0.20 |
| | Lead | <0.20 |
| | Lithium | <0.02 |
| | Nickel | <0.20 |
| | Vanadium | <0.05 |
| | Zinc | <0.02 |
| | Arsenic | <0.20 |
| | Mercury | <0.20 |
| | Cadmium | <0.03 |
| | Chromium | <0.02 |
| | Manganese | <0.05 |
| | Silver | <0.05 |
| | Titanium | <0.05 |
| | Selenium | <0.50 |
| UOP779 | Chloride organic | <1 |
| UOP779 | Chloride inorganic | 7.24 |
| AOCS Ba 4e-93 | Nitrogen | 6.7 |

TABLE 18

Solid Fat Content of RBD469 Oil

| Method Number | Solid Fat Content | Result |
|---|---|---|
| AOCS Cd 12b-93 | Solid Fat Content 10° C. | 0.13% |
| AOCS Cd 12b-93 | Solid Fat Content 15° C. | 0.13% |
| AOCS Cd 12b-93 | Solid Fat Content 20° C. | 0.28% |
| AOCS Cd 12b-93 | Solid Fat Content 25° C. | 0.14% |
| AOCS Cd 12b-93 | Solid Fat Content 30° C. | 0.08% |
| AOCS Cd 12b-93 | Solid Fat Content 35° C. | 0.25% |

TABLE 19

Lovibond Color of RBD469 Oil

| Method Number | Color | Result | Unit |
|---|---|---|---|
| AOCS Cc 13j-97 | red | 2 | Unit |
| AOCS Cc 13j-97 | yellow | 27 | Unit |

RBD469 oil was subjected to transesterification to produce fatty acid methyl esters (FAMEs). The resulting FAME profile of RBD469 is shown in Table 20.

TABLE 20

FAME Profile of RBD469 Oil

| Fatty Acid | Area % |
|---|---|
| C10 | 0.01 |
| C12:0 | 0.04 |
| C14:0 | 0.64 |
| C15:0 | 0.08 |
| C16:0 | 8.17 |
| C16:1 iso | 0.39 |
| C16:1 | 0.77 |
| C17:0 | 0.08 |
| C18:0 | 1.93 |
| C18:1 | 85.88 |
| C18:1 iso | 0.05 |
| C18:2 | 0.05 |
| C20:0 | 0.3 |
| C20:1 | 0.06 |
| C20:1 | 0.44 |
| C22:0 | 0.11 |
| C23:0 | 0.03 |
| C24:0 | 0.1 |
| Total FAMEs Identified | 99.13 |

The oil stability indexes (OSI) of 6 RBD oil samples without supplemented antioxidants and 3 RBD oil samples supplemented with antioxidants were analyzed according to the Oil Stability Index AOCS Method Cd 12b-92. Shown in Table 21 are the results of OSI AOCS Cd 12b-92 tests, conducted at 110° C., performed using a Metrohm 873 Biodiesel Rancimat. Results, except where indicated with an astericks (*), are the average of multiple OSI runs. Those samples not analyzed are indicated (NA).

TABLE 21

Oil Stability Index at 110° C. of RBD oil samples with and without antioxidants

| Antioxidant added | Antioxidant Concentration | OSI (hours) for each RBD Sample | | | | | |
|---|---|---|---|---|---|---|---|
| | | RBD437 | RBD469 | RBD502 | RBD501 | RBD503 | RBD529 |
| None | 0 | 65.41 | 38.33 | 72.10 | 50.32 | 63.04 | 26.68 |
| Tocopherol & Ascorbyl Palmitate | 35 ppm/ 16.7 ppm | 77.72 | 48.60 | 82.67 | NA | NA | NA |
| Tocopherol & Ascorbyl Palmitate | 140 ppm/ 66.7 ppm | 130.27 | 81.54* | 211.49* | NA | NA | NA |
| Tocopherol & Ascorbyl Palmitate | 1050 ppm/ 500 ppm | >157* | >144 | 242.5* | NA | NA | NA |
| Tocopherol | 50 ppm | NA | 46.97 | NA | NA | NA | NA |
| TBHQ | 20 ppm | 63.37 | 37.4 | NA | NA | NA | NA |

The untransformed *P. moriformis* (UTEX 1435) acid profile comprises less than 60% C18:1 fatty acids and greater than 7% C18:2 fatty acids. In contrast, Strain D (comprising pSZ1500) exhibited fatty acid profiles with an increased composition of C18:1 fatty acids (to above 85%) and a decrease in C18:2 fatty acids (to less than 0.06%). Upon refining, bleaching, and degumming, RBD oils samples prepared from the oil made from strain E exhibited OSI values >26 hrs. With addition of antioxidants, the OSI of RBD oils prepared from oils of Strain D increased from 48.60 hours to greater than 242 hours.

Example 8

Improving the Levels of Oleic Acid of Engineered Microbes through Allelic Disruption of a Fatty Acid Desaturase and an Acyl-ACP Thioesterase This example describes the use of a transformation vector to disrupt a FATA locus of a *Prototheca moriformis* strain previously engineered for high oleic acid and low linoleic acid production. The transformation cassette used in this example comprised a selectable marker and nucleotide sequences encoding a *P. moriformis* KASII enzyme to engineer microorganisms in which the fatty acid profile of the transformed microorganism has been altered for further increased oleic acid and lowered palmitic acid levels.

Strain D, described in Example 7 and in PCT/US2012/023696, is a classically mutagenized (for higher oil production) derivative of *P. moriformis* (UTEX 1435) subsequently transformed with the transformation construct pSZ1500 (SEQ ID NO: 137) according to biolistic transformation methods in Example 2 and as described in PCT/US2009/066141, PCT/US2009/066142, PCT/US2011/038463, PCT/US2011/038464, and PCT/US2012/023696. This strain was used as the host for transformation with construct pSZ2276 to increase expression of a KASII enzyme while concomitantly ablating an endogenous acyl-ACP thioesterase genetic locus to generate Strain E. The pSZ2276 transformation construct included 5' (SEQ ID NO: 140) and 3' (SEQ ID NO: 141) homologous recombination targeting sequences (flanking the construct) to the FATA1 genomic region for integration into the *P. moriformis* nuclear genome, an *A. thaliana* THIC protein coding region under the control of the *C. protothecoides* actin promoter/5'UTR (SEQ ID NO: 142) and *C. vulgaris* nitrate reductase 3' UTR (SEQ ID NO: 126). This AtTHIC expression cassette is listed as SEQ ID NO: 143 and served as a selection marker. The *P. moriformis* KASII protein coding region was under the control of the *P. moriformis* Amt03 promoter/5'UTR (SEQ ID NO: 128) and *C. vulgaris* nitrate reductase 3'UTR, and the native transit peptide of the KASII enzyme was replaced with the *C. protothecoides* stearoyl-ACP desaturase transit peptide (SEQ ID NO: 129). The codon-optimized sequence of PmKASII comprising a *C. protothecoides* S106 stearoyl-ACP desaturase transit peptide is provided the sequence listings as SEQ ID NO: 144. SEQ ID NO: 145 provides the protein translation of SEQ ID NO: 144. The protein coding regions of PmKASII and suc2 were codon optimized to reflect the codon bias inherent in *P. moriformis* UTEX 1435 nuclear genes as described in PCT/US2009/066141, PCT/US2009/066142, PCT/US2011/038463, PCT/US2011/038464, and PCT/US2012/023696.

Primary pSZ2276 transformants of Strain D were selected on agar plates lacking thiamine, clonally purified, and a single engineered line, strain E was selected for analysis. Strain E was cultivated under heterotrophic lipid production conditions at pH5.0 and pH7.0 as described in PCT/US2009/066141, PCT/US2009/066142, PCT/US2011/038463, PCT/US2011/038464, and PCT/US2012/023696. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic line arising from transformation with pSZ2276 into Strain D are shown in Table 22.

TABLE 22

Fatty acid profiles of *Prototheca moriformis* (UTEX 1435) Strains A, D, and E engineered for increased oleic acid and lowered linoleic acid levels.

| Strain | Transformation Construct(s) | pH | C16:0 | C18:0 | C18:1 | C18:2 | C20:1 |
|---|---|---|---|---|---|---|---|
| Strain A | None | pH 5 | 26.6 | 3.3 | 60.5 | 6.7 | 0.07 |
| Strain A | None | pH 7 | 28.3 | 4.1 | 58 | 6.5 | 0.06 |
| Strain D | pSZ1500 | pH 5 | 17 | 3.6 | 77.1 | 0.01 | 0.14 |
| Strain D | pSZ1500 | pH 7 | 19.5 | 5.3 | 72.6 | 0.01 | 0.09 |
| Strain E | pSZ1500 + pSZ2276 | pH 5 | 4.1 | 2.36 | 88.5 | 0.04 | 3.1 |
| Strain E | pSZ1500 + pSZ2276 | pH 7 | 2.1 | 7.8 | 87.9 | 0.01 | 0.5 |

As shown in Table 22, targeted interruption of FADc alleles with a CtOTE expression cassette impacted the fatty acid profiles of transformed microorganisms. Fatty acid profiles of Strain D (comprising the pSZ1500 transformation vector) showed increased composition of C18:1 fatty acids with a concomitant decrease in C16:0 and C18:2 fatty acids relative to Strain A. Subsequent transformation of Strain D with pSZ2276 to overexpress a *P. moriformis* (UTEX 1435) KASII protein while concomitantly ablating a FATA genetic locus (thereby generating Strain E) resulted in still further impact on the fatty acid profiles of the transformed microorganisms. Fatty acid profiles of Strain E showed increased composition of C18:1 fatty acids, with a further decrease in C16:0 fatty acids relative to Strains A and D. Propagation of Strain E in culture conditions at pH 7, to induce expression from the Amt03 promoter, resulted in a fatty acid profile that was higher in C18:0 and C18:1 fatty acids and lower in C16:0 fatty acids, relative to the same strain cultured at pH 5.

These data demonstrate the utility of multiple genetic modifications to impact the fatty acid profile of a host organism for increased levels of oleic acid with concomitant decreased levels of linoleic acid and palmitic acid. Further, this example illustrates the use of recombinant polynucleotides to target gene interruption of an endogenous FATA allele with a cassette comprising a pH-regulatable promoter to control expression of an exogenous KASII protein-coding region in order to alter the fatty acid profile of a host microbe.

Example 9

Conditional Expression of a Fatty Acid Desaturase

This example describes the use of a transformation vector to conditionally express a delta 12 fatty acid desaturase (FAD) in a *Prototheca moriformis* strain previously engineered for high oleic acid and very low linoleic acid production in both seed and lipid productivity stages of propagation. Very low linoleic acid levels in natural oils are sought for use in certain applications. However, absence of linoleic acid during cell division phase ("seed stage") of a host microbe is disadvantageous. Linoleic acid may be supplemented to the seed medium to hasten cell division and not added during lipid production, but this addition imposes unwanted costs. To overcome this challenge, a transformation cassette was constructed for regulated expression of a FAD2 enzyme such that levels of linoleic acids sufficient for cell division could be achieved and oil with very low levels of linoleic acids could be produced during the oil production phase of culture of a microorgansim. The transformation cassette used in this example comprised a selectable marker, a pH-regulatable promoter, and nucleotide sequences encoding a *P. moriformis* FAD2 enzyme to engineer microorganisms in which the fatty acid profile of the transformed microorganism has been altered for increased oleic acid production and regulatable linoleic acid production.

Strain D, described in Examples 7 and 8 and in PCT/US2012/023696, is a classically mutagenized (for higher oil production) derivative of *P. moriformis* (UTEX 1435) subsequently transformed with the transformation construct pSZ1500 (SEQ ID NO: 137) according to biolistic transformation methods as described in PCT/US2009/066141, PCT/US2009/066142, PCT/US2011/038463, PCT/US2011/038464, and PCT/US2012/023696. This strain was used as the host for transformation with construct pSZ2413 to introduce a pH-driven promoter for regulation of a *P. moriformis* FAD2 enzyme. The pSZ2413 transformation construct included 5' (SEQ ID NO: 121) and 3' (SEQ ID NO: 122) homologous recombination targeting sequences (flanking the construct) to the 6S genomic region for integration into the *P. moriformis* nuclear genome, an *A. thaliana* THIC protein coding region under the control of the *C. protothecoides* actin promoter/5'UTR (SEQ ID NO: 142) and *C. vulgaris* nitrate reductase 3' UTR (SEQ ID NO: 126). This AtTHIC expression cassette is listed as SEQ ID NO: 143 and served as a selection marker. The *P. moriformis* FAD2 protein coding region was under the control of the *P. moriformis* Amt03 promoter/5'UTR (SEQ ID NO: 128) and *C. vulgaris* nitrate reductase 3'UTR. The codon-optimized sequence of PmFAD2 is provided the sequence listings as SEQ ID NO: 146. SEQ ID NO: 147 provides the protein translation of SEQ ID NO: 146. The protein coding regions of PmFAD2 and suc2 were codon optimized to reflect the codon bias inherent in *P. moriformis* UTEX 1435 nuclear genes as described in PCT/US2009/066141, PCT/US2009/066142, PCT/US2011/038463, PCT/US2011/038464, and PCT/US2012/023696.

Primary pSZ2413 transformants of Strain D were selected on agar plates lacking thiamine, clonally purified, and isolates of the engineered line, Strain F were selected for analysis. These isolates were cultivated under heterotrophic lipid production conditions at pH7.0 (to activate expression of FAD2 from the PmAmt03 promoter) and at pH5.0, as described in PCT/US2009/066141, PCT/US2009/066142, PCT/US2011/038463, PCT/US2011/038464, and PCT/US2012/023696. Lipid samples were prepared from dried biomass from each transformant and fatty acid profiles from these samples were analyzed using standard fatty acid methyl ester gas chromatography flame ionization (FAME GC/FID) detection methods as described in Example 3. The resulting profile of C18:2 fatty acids (expressed in Area %) from nine representative isolates of transgenic Strain F (F-1 through F-9) arising from transformation with pSZ2413 into Strain D are shown in Table 23.

TABLE 23

C18:2 fatty acid profiles of *Protheca moriformis* (UTEX 1435) Strains A, D, and F.

| Strain | Transformation Construct (s) | Area % C18:2 pH 5.0 | Area % C18:2 pH 7.0 |
|---|---|---|---|
| A | None | 6.07 | 7.26 |
| D | pSZ1500 | 0.01 | 0.01 |
| F-1 | pSZ1500 + pSZ2413 | 0.37 | 5.29 |
| F-2 | pSZ1500 + pSZ2413 | 0.45 | 6.87 |
| F-3 | pSZ1500 + pSZ2413 | 0.50 | 6.79 |
| F-4 | pSZ1500 + pSZ2413 | 0.57 | 5.06 |
| F-5 | pSZ1500 + pSZ2413 | 0.57 | 7.58 |
| F-6 | pSZ1500 + pSZ2413 | 0.60 | 6.88 |
| F-7 | pSZ1500 + pSZ2413 | 0.62 | 6.52 |
| F-8 | pSZ1500 + pSZ2413 | 0.63 | 5.79 |
| F-9 | pSZ1500 + pSZ2413 | 0.77 | 4.53 |

As shown in Table 23 the impact of regulated expression of the PmFAD2 enzyme, effected though strain culture at different pH levels, is a clear increase in the composition of C18:2 fatty acids in the transformed microorganism. Linoleic acid comprises about 6% to about 7.3% of fatty acids of Strain A. In contrast, Strain D (comprising the pSZ1500 transformation vector to ablate both FAD2 alleles) is characterized by a fatty acid profile of 0.01% linoleic acid. Transformation of Strain D with pSZ2413 to generate Strain F results in a recombinant microbe in which the production of linoleic acid is regulated by the Amt03 promoter. Propagation of Strain F isolates in culture conditions at pH 7, to induce FAD2 expression from the Amt03 promoter, resulted in a fatty acid profile characterized by about 4.5% to about 7.5% linoleic acid. In contrast, propagation of Strain F isolates in culture conditions at pH 5 resulted in a fatty acid profile characterized by about 0.33 to about 0.77% linoleic acid.

These data demonstrate the utility of and effectiveness of recombinant polynucleotides permitting conditional expression of a FAD2 enzyme to alter the fatty acid profile of engineered microorganisms, and in particular in regulating the production of C18:2 fatty acids in microbial cells.

Examples 10-33

Introduction and Tables

Examples 10-33 below describe the engineering of various microorganisms in accordance with the present invention. To alter the fatty acid profile of a microorganism, microorganisms may be genetically modified wherein endogenous or exogenous lipid biosynthesis pathway enzymes are expressed, overexpressed, or attenuated. Steps to genetically engineer a microbe to alter its fatty acid profile as to the degree of fatty acid unsaturation and to decrease or increase fatty acid chain length comprise the design and construction of a transformation vector (e.g., a plasmid), transformation of the microbe with one or more vectors, selection of transformed microbes (transformants), growth of the transformed microbe, and analysis of the fatty acid profile of the lipids produced by the engineered microbe.

Transgenes that alter the fatty acid profiles of host organisms may be expressed in numerous eukaryotic microbes. Examples of expression of transgenes in eukaryotic microbes including *Chlamydomonas reinhardtii*, *Chlorella ellipsoidea*, *Chlorella protothecoides*, *Chlorella saccarophila*, *Chlorella vulgaris*, *Chlorella kessleri*, *Chlorella sorokiniana*, *Haematococcus pluvialis*, *Gonium pectorale*, *Volvox carteri*, *Dunaliella tertiolecta*, *Dunaliella viridis*, *Dunaliella salina*, *Closterium peracerosum-strigosum-littorale* complex, *Nannochloropsis* sp., *Thalassiosira pseudonana*, *Phaeodactylum tricornutum*, *Navicula saprophila*, *Cylindrotheca fusiformis*, *Cyclotella cryptica*, *Symbiodinium microadriacticum*, *Amphidinium* sp., *Chaetoceros* sp., *Mortierella alpina*, and *Yarrowia lipolytica* may be found in the scientific literature. These expression techniques may be combined with the teachings of the present invention to produce engineered microorganisms with altered fatty acid profiles.

Transgenes that alter the fatty acid profiles of host organisms or alter the regiospecific distribution of glycerolipids produced by host organisms can also be expressed in numerous prokaryotic microbes. Examples of expression of transgenes in oleaginous microbes including *Rhodococcus opacus* may be found in the literature. These expression techniques may be combined with the teachings of the present invention to produce engineered microorganisms with altered fatty acid profiles.

Tables 24A-E. Codon Preference Listing

TABLE 24A

| Amino Acid | Codon | Chlorella sorokiniana | Chlorella vulgaris | Chlorella ellipsoidea | Chlorella kessleri | Dunaliella tertiolecta | Volvox carteri | Haematococcus pluvialis |
|---|---|---|---|---|---|---|---|---|
| Ala | GCG | 0.20 | 0.25 | 0.15 | 0.14 | 0.09 | 0.25 | 0.21 |
| Ala | GCA | 0.05 | 0.24 | 0.32 | 0.10 | 0.17 | 0.13 | 0.27 |
| Ala | GCT | 0.12 | 0.16 | 0.26 | 0.18 | 0.31 | 0.26 | 0.17 |
| Ala | GCC | 0.63 | 0.35 | 0.27 | 0.58 | 0.43 | 0.36 | 0.35 |
| Arg | AGG | 0.03 | 0.09 | 0.10 | 0.09 | 0.26 | 0.08 | 0.14 |
| Arg | AGA | 0.04 | 0.05 | 0.14 | 0.01 | 0.09 | 0.03 | 0.05 |
| Arg | CGG | 0.06 | 0.19 | 0.09 | 0.06 | 0.06 | 0.17 | 0.15 |
| Arg | CGA | 0.00 | 0.10 | 0.08 | 0.00 | 0.08 | 0.08 | 0.10 |
| Arg | CGT | 0.06 | 0.09 | 0.37 | 0.14 | 0.12 | 0.22 | 0.13 |
| Arg | CGC | 0.81 | 0.48 | 0.22 | 0.71 | 0.40 | 0.43 | 0.42 |
| Asn | AAT | 0.04 | 0.16 | 0.43 | 0.06 | 0.27 | 0.23 | 0.21 |

TABLE 24A-continued

| Amino Acid | Codon | Chlorella sorokiniana | Chlorella vulgaris | Chlorella ellipsoidea | Chlorella kessleri | Dunaliella tertiolecta | Volvox carteri | Haematococcus pluvialis |
|---|---|---|---|---|---|---|---|---|
| Asn | AAC | 0.96 | 0.84 | 0.57 | 0.94 | 0.73 | 0.77 | 0.79 |
| Asp | GAT | 0.13 | 0.25 | 0.47 | 0.12 | 0.40 | 0.35 | 0.27 |
| Asp | GAC | 0.87 | 0.75 | 0.53 | 0.88 | 0.60 | 0.65 | 0.73 |
| Cys | TGT | 0.06 | 0.13 | 0.43 | 0.09 | 0.20 | 0.17 | 0.27 |
| Cys | TGC | 0.94 | 0.87 | 0.57 | 0.91 | 0.80 | 0.83 | 0.64 |
| End | TGA | 0.00 | 0.72 | 0.14 | 0.14 | 0.36 | 0.24 | 0.70 |
| End | TAG | 0.33 | 0.11 | 0.29 | 0.00 | 0.00 | 0.18 | 0.22 |
| End | TAA | 0.67 | 0.17 | 4.00 | 0.86 | 0.64 | 0.59 | 0.09 |
| Gln | CAG | 0.42 | 0.40 | 0.15 | 0.40 | 0.27 | 0.29 | 0.33 |
| Gln | CAA | 0.04 | 0.04 | 0.21 | 0.40 | 0.27 | 0.07 | 0.10 |
| Glu | GAG | 0.53 | 0.50 | 0.33 | 0.40 | 0.27 | 0.53 | 0.49 |
| Glu | GAA | 0.02 | 0.06 | 0.31 | 0.40 | 0.27 | 0.11 | 0.07 |
| Gly | GGG | 0.04 | 0.16 | 0.19 | 0.08 | 0.10 | 0.12 | 0.22 |
| Gly | GGA | 0.02 | 0.11 | 0.13 | 0.07 | 0.13 | 0.12 | 0.11 |
| Gly | GGT | 0.03 | 0.12 | 0.39 | 0.24 | 0.25 | 0.23 | 0.15 |
| Gly | GGC | 0.91 | 0.61 | 0.29 | 0.96 | 0.51 | 0.53 | 0.52 |
| His | CAT | 0.14 | 0.16 | 0.30 | 0.08 | 0.25 | 0.35 | 0.27 |
| His | CAC | 0.86 | 0.84 | 0.70 | 0.93 | 0.75 | 0.65 | 0.73 |
| Ile | ATA | 0.00 | 0.04 | 0.07 | 0.01 | 0.04 | 0.08 | 0.09 |
| Ile | ATT | 0.15 | 0.30 | 0.63 | 0.29 | 0.31 | 0.35 | 0.29 |
| Ile | ATC | 0.85 | 0.66 | 0.65 | 0.69 | 0.65 | 0.57 | 0.62 |
| Leu | TTG | 0.03 | 0.07 | 0.03 | 0.05 | 0.14 | 0.14 | 0.16 |
| Leu | TTA | 0.00 | 0.01 | 0.32 | 0.00 | 0.02 | 0.03 | 0.02 |
| Leu | CTG | 0.72 | 0.61 | 0.34 | 0.61 | 0.60 | 0.45 | 0.53 |
| Leu | CTA | 0.01 | 0.03 | 0.03 | 0.04 | 0.04 | 0.07 | 0.07 |
| Leu | CTT | 0.04 | 0.08 | 0.16 | 0.06 | 0.06 | 0.14 | 0.09 |
| Leu | CTC | 0.20 | 0.20 | 0.12 | 0.24 | 0.14 | 0.17 | 0.13 |
| Lys | AAG | 0.98 | 0.94 | 0.54 | 0.98 | 0.90 | 0.90 | 0.84 |
| Lys | AAA | 0.02 | 0.06 | 0.46 | 0.02 | 0.10 | 0.10 | 0.16 |
| Met | ATG | 1.00 | 1.00 | 1.00 | 1.00 | 1.00 | 1.00 | 1.00 |
| Phe | TTT | 0.28 | 0.32 | 0.42 | 0.31 | 0.24 | 0.27 | 0.35 |
| Phe | TTC | 0.72 | 0.68 | 0.58 | 0.69 | 0.76 | 0.73 | 0.65 |
| Pro | CCG | 0.18 | 0.31 | 0.09 | 0.07 | 0.04 | 0.34 | 0.15 |
| Pro | CCA | 0.06 | 0.17 | 0.36 | 0.07 | 0.04 | 0.20 | 0.24 |
| Pro | CCT | 0.10 | 0.14 | 0.25 | 0.17 | 0.04 | 0.19 | 0.29 |
| Pro | CCC | 0.66 | 0.38 | 0.29 | 0.69 | 0.04 | 0.27 | 0.32 |
| Ser | AGT | 0.03 | 0.04 | 0.14 | 0.02 | 0.08 | 0.08 | 0.07 |
| Ser | AGC | 0.27 | 0.38 | 0.18 | 0.18 | 0.31 | 0.27 | 0.31 |

TABLE 24A-continued

| Amino Acid | Codon | Chlorella sorokiniana | Chlorella vulgaris | Chlorella ellipsoidea | Chlorella kessleri | Dunaliella tertiolecta | Volvox carteri | Haematococcus pluvialis |
|---|---|---|---|---|---|---|---|---|
| Ser | TCG | 0.12 | 0.14 | 0.08 | 0.10 | 0.02 | 0.19 | 0.10 |
| Ser | TCA | 0.03 | 0.08 | 0.14 | 0.08 | 0.09 | 0.09 | 0.14 |
| Ser | TCT | 0.09 | 0.11 | 0.26 | 0.18 | 0.19 | 0.14 | 0.13 |
| Ser | TCC | 0.47 | 0.24 | 0.20 | 0.44 | 0.30 | 0.24 | 0.24 |
| Thr | ACG | 0.11 | 0.20 | 0.13 | 0.05 | 0.12 | 0.27 | 0.19 |
| Thr | ACA | 0.01 | 0.20 | 0.32 | 0.07 | 0.20 | 0.12 | 0.23 |
| Thr | ACT | 0.12 | 0.13 | 0.29 | 0.12 | 0.24 | 0.20 | 0.18 |
| Thr | ACC | 0.76 | 0.47 | 0.26 | 0.76 | 0.44 | 0.41 | 0.40 |
| Trp | TGG | 1.00 | 1.00 | 1.00 | 1.00 | 1.00 | 1.00 | 1.00 |
| Tyr | TAT | 0.07 | 0.15 | 0.43 | 0.27 | 0.28 | 0.24 | 0.19 |
| Tyr | TAC | 0.93 | 0.85 | 0.57 | 0.73 | 0.72 | 0.76 | 0.81 |
| Val | GTG | 0.71 | 0.54 | 0.37 | 0.60 | 0.54 | 0.46 | 0.62 |
| Val | GTA | 0.00 | 0.05 | 0.25 | 0.03 | 0.09 | 0.07 | 0.09 |
| Val | GTT | 0.11 | 0.14 | 0.24 | 0.09 | 0.14 | 0.17 | 0.09 |
| Val | GTC | 0.18 | 0.27 | 0.14 | 0.28 | 0.23 | 0.30 | 0.21 |

TABLE 24B

| Amino Acid | Codon | Closterium peracerosum-strigosum-littorale complex | Dunaliella viridis | Dunaliella salina | Gonium pectorale | Phaeodactylum tricornutum | Chaetoceros compressum |
|---|---|---|---|---|---|---|---|
| Ala | GCG | 0.48 | 0.13 | 0.15 | 0.43 | 0.15 | 0.08 |
| Ala | GCA | 0.10 | 0.27 | 0.20 | 0.09 | 0.10 | 0.37 |
| Ala | GCT | 0.15 | 0.25 | 0.27 | 0.08 | 0.23 | 0.36 |
| Ala | GCC | 0.26 | 0.35 | 0.39 | 0.41 | 0.52 | 0.18 |
| Arg | AGG | 0.04 | 0.25 | 0.22 | 0.13 | 0.02 | 0.14 |
| Arg | AGA | 0.00 | 0.06 | 0.05 | 0.00 | 0.04 | 0.29 |
| Arg | CGG | 0.18 | 0.08 | 0.12 | 0.40 | 0.10 | 0.00 |
| Arg | CGA | 0.00 | 0.06 | 0.06 | 0.05 | 0.12 | 0.19 |
| Arg | CGT | 0.13 | 0.15 | 0.13 | 0.08 | 0.41 | 0.38 |
| Arg | CGC | 0.64 | 0.39 | 0.43 | 0.35 | 0.31 | 0.00 |
| Asn | AAT | 0.04 | 0.17 | 0.23 | 0.07 | 0.30 | 0.58 |
| Asn | AAC | 0.96 | 0.83 | 0.77 | 0.93 | 0.65 | 0.42 |
| Asp | GAT | 0.30 | 0.38 | 0.40 | 0.11 | 0.41 | 0.53 |
| Asp | GAC | 0.70 | 0.62 | 0.60 | 0.89 | 0.59 | 0.47 |
| Cys | TGT | 0.06 | 0.24 | 0.17 | 0.20 | 0.39 | 0.44 |
| Cys | TGC | 0.94 | 0.76 | 0.83 | 0.90 | 0.61 | 0.56 |
| End | TGA | 0.75 | 0.31 | 0.37 | 0.50 | 0.06 | 0.50 |
| End | TAG | 0.00 | 0.15 | 0.14 | 0.00 | 0.13 | 0.00 |

TABLE 24B-continued

| Amino Acid | Codon | Closterium peracerosum-strigosum-littorale complex | Dunaliella viridis | Dunaliella salina | Gonium pectorale | Phaeodactylum tricornutum | Chaetoceros compressum |
|---|---|---|---|---|---|---|---|
| End | TAA | 0.25 | 0.54 | 0.49 | 0.50 | 0.81 | 0.50 |
| Gln | CAG | 0.53 | 0.36 | 0.32 | 0.31 | 0.23 | 0.16 |
| Gln | CAA | 0.09 | 0.12 | 0.08 | 0.07 | 0.14 | 0.19 |
| Glu | GAG | 0.31 | 0.44 | 0.51 | 0.56 | 0.21 | 0.28 |
| Glu | GAA | 0.06 | 0.09 | 0.09 | 0.07 | 0.42 | 0.37 |
| Gly | GGG | 0.31 | 0.14 | 0.10 | 0.18 | 0.08 | 0.12 |
| Gly | GGA | 0.06 | 0.11 | 0.12 | 0.09 | 0.34 | 0.33 |
| Gly | GGT | 0.09 | 0.22 | 0.22 | 0.07 | 0.30 | 0.39 |
| Gly | GGC | 0.53 | 0.54 | 0.56 | 0.65 | 0.28 | 0.16 |
| His | CAT | 0.33 | 0.25 | 0.25 | 0.43 | 0.28 | 0.84 |
| His | CAC | 0.67 | 0.75 | 0.75 | 0.57 | 0.72 | 0.16 |
| Ile | ATA | 0.03 | 0.03 | 0.03 | 0.07 | 0.03 | 0.12 |
| Ile | ATT | 0.23 | 0.25 | 0.31 | 0.33 | 0.51 | 0.65 |
| Ile | ATC | 0.74 | 0.72 | 0.66 | 0.59 | 0.46 | 0.23 |
| Leu | TTG | 0.04 | 0.11 | 0.12 | 0.04 | 0.26 | 0.11 |
| Leu | TTA | 0.00 | 0.01 | 0.01 | 0.00 | 0.02 | 0.14 |
| Leu | CTG | 0.31 | 0.60 | 0.61 | 0.64 | 0.15 | 0.05 |
| Leu | CTA | 0.01 | 0.05 | 0.04 | 0.01 | 0.05 | 0.08 |
| Leu | CTT | 0.04 | 0.07 | 0.08 | 0.05 | 0.18 | 0.51 |
| Leu | CTC | 0.60 | 0.16 | 0.14 | 0.26 | 0.34 | 0.11 |
| Lys | AAG | 0.86 | 0.87 | 0.89 | 0.93 | 0.75 | 0.52 |
| Lys | AAA | 0.14 | 0.13 | 0.11 | 0.07 | 0.25 | 0.48 |
| Met | ATG | 1.00 | 1.00 | 1.00 | 1.00 | 1.00 | 1.00 |
| Phe | TTT | 0.09 | 0.25 | 0.29 | 0.10 | 0.44 | 0.65 |
| Phe | TTC | 0.91 | 0.75 | 0.71 | 0.90 | 0.56 | 0.35 |
| Pro | CCG | 0.28 | 0.10 | 0.08 | 0.53 | 0.29 | 0.05 |
| Pro | CCA | 0.15 | 0.10 | 0.17 | 0.09 | 0.12 | 0.45 |
| Pro | CCT | 0.12 | 0.10 | 0.30 | 0.04 | 0.20 | 0.33 |
| Pro | CCC | 0.44 | 0.10 | 0.45 | 0.34 | 0.40 | 0.17 |
| Ser | AGT | 0.04 | 0.09 | 0.06 | 0.02 | 0.12 | 0.14 |
| Ser | AGC | 0.05 | 0.31 | 0.32 | 0.20 | 0.12 | 0.07 |
| Ser | TCG | 0.22 | 0.04 | 0.06 | 0.42 | 0.19 | 0.08 |
| Ser | TCA | 0.16 | 0.08 | 0.10 | 0.09 | 0.06 | 0.31 |
| Ser | TCT | 0.05 | 0.17 | 0.15 | 0.07 | 0.15 | 0.23 |
| Ser | TCC | 0.47 | 0.31 | 0.30 | 0.20 | 0.35 | 0.18 |
| Thr | ACG | 0.30 | 0.16 | 0.13 | 0.42 | 0.23 | 0.10 |
| Thr | ACA | 0.06 | 0.21 | 0.18 | 0.03 | 0.13 | 0.38 |

TABLE 24B-continued

| Amino Acid | Codon | Closterium peracerosum-strigosum-littorale complex | Dunaliella viridis | Dunaliella salina | Gonium pectorale | Phaeodactylum tricornutum | Chaetoceros compressum |
|---|---|---|---|---|---|---|---|
| Thr | ACT | 0.22 | 0.18 | 0.23 | 0.08 | 0.19 | 0.27 |
| Thr | ACC | 0.42 | 0.46 | 0.46 | 0.47 | 0.45 | 0.25 |
| Trp | TGG | 1.00 | 1.00 | 1.00 | 1.00 | 1.00 | 1.00 |
| Tyr | TAT | 0.07 | 0.16 | 0.21 | 0.12 | 0.18 | 0.67 |
| Tyr | TAC | 0.93 | 0.84 | 0.79 | 0.88 | 0.82 | 0.33 |
| Val | GTG | 0.50 | 0.64 | 0.62 | 0.57 | 0.22 | 0.30 |
| Val | GTA | 0.02 | 0.03 | 0.05 | 0.04 | 0.09 | 0.27 |
| Val | GTT | 0.06 | 0.11 | 0.11 | 0.04 | 0.22 | 0.10 |
| Val | GTC | 0.42 | 0.22 | 0.23 | 0.35 | 0.47 | 0.33 |

TABLE 24C

| Amino Acid | Codon | Cylindrotheca fusiformis | Amphidinium carterae | Symbiodinium microadriacticum | Nannochloropsis sp | Cyclotella cryptica | Navicula pelliculosa | Thalassiosira pseudonana | C. reinhardtii |
|---|---|---|---|---|---|---|---|---|---|
| Ala | GCG | 0.07 | 0.17 | 0.22 | 0.24 | 0.11 | 0.00 | 0.11 | 0.35 |
| Ala | GCA | 0.14 | 0.33 | 0.26 | 0.10 | 0.16 | 0.13 | 0.25 | 0.08 |
| Ala | GCT | 0.35 | 0.29 | 0.20 | 0.17 | 0.45 | 0.44 | 0.33 | 0.13 |
| Ala | GCC | 0.43 | 0.20 | 0.32 | 0.48 | 0.27 | 0.44 | 0.30 | 0.43 |
| Arg | AGG | 0.09 | 0.15 | 0.27 | 0.00 | 0.09 | 0.05 | 0.18 | 0.05 |
| Arg | AGA | 0.14 | 0.03 | 0.27 | 0.00 | 0.05 | 0.10 | 0.17 | 0.01 |
| Arg | CGG | 0.06 | 0.08 | 0.09 | 0.00 | 0.04 | 0.05 | 0.06 | 0.20 |
| Arg | CGA | 0.16 | 0.18 | 0.09 | 0.29 | 0.08 | 0.35 | 0.11 | 0.04 |
| Arg | CGT | 0.34 | 0.18 | 0.09 | 0.14 | 0.47 | 0.20 | 0.34 | 0.09 |
| Arg | CGC | 0.22 | 0.40 | 0.18 | 0.57 | 0.28 | 0.25 | 0.15 | 0.62 |
| Asn | AAT | 0.42 | 0.37 | 0.21 | 0.00 | 0.25 | 0.47 | 0.43 | 0.09 |
| Asn | AAC | 0.58 | 0.63 | 0.79 | 1.00 | 0.75 | 0.53 | 0.57 | 0.91 |
| Asp | GAT | 0.54 | 0.54 | 0.50 | 0.20 | 0.52 | 0.20 | 0.56 | 0.14 |
| Asp | GAC | 0.46 | 0.46 | 0.50 | 0.80 | 0.48 | 0.80 | 0.44 | 0.86 |
| Cys | TGT | 0.44 | 0.75 | 0.50 | 0.00 | 0.29 | 0.10 | 0.54 | 0.10 |
| Cys | TGC | 0.56 | 0.25 | 0.50 | 1.00 | 0.71 | 0.90 | 0.46 | 0.90 |
| End | TGA | 0.13 | 0.50 | 1.00 | 0.00 | 0.10 | 0.00 | 0.31 | 0.27 |
| End | TAG | 0.10 | 0.00 | 0.00 | 0.00 | 0.00 | 0.00 | 0.38 | 0.22 |
| End | TAA | 0.77 | 0.50 | 0.00 | 1.00 | 0.90 | 1.00 | 0.31 | 0.52 |
| Gln | CAG | 0.12 | 0.33 | 0.28 | 0.41 | 0.19 | 0.21 | 0.16 | 0.38 |
| Gln | CAA | 0.25 | 0.15 | 0.17 | 0.00 | 0.17 | 0.28 | 0.19 | 0.04 |
| Glu | GAG | 0.23 | 0.41 | 0.50 | 0.59 | 0.38 | 0.17 | 0.40 | 0.55 |
| Glu | GAA | 0.39 | 0.10 | 0.06 | 0.00 | 0.26 | 0.34 | 0.26 | 0.03 |

TABLE 24C-continued

| Amino Acid | Codon | Cylindrotheca fusiformis | Amphidinium carterae | Symbiodinium microadriacticum | Nannochloropsis sp | Cyclotella cryptica | Navicula pelliculosa | Thalassiosira pseudonana | C. reinhardtii |
|---|---|---|---|---|---|---|---|---|---|
| Gly | GGG | 0.06 | 0.19 | 0.32 | 0.10 | 0.10 | 0.03 | 0.12 | 0.11 |
| Gly | GGA | 0.47 | 0.10 | 0.12 | 0.05 | 0.45 | 0.28 | 0.51 | 0.06 |
| Gly | GGT | 0.35 | 0.34 | 0.16 | 0.25 | 0.22 | 0.13 | 0.23 | 0.11 |
| Gly | GGC | 0.12 | 0.37 | 0.40 | 0.60 | 0.24 | 0.56 | 0.14 | 0.72 |
| His | CAT | 0.39 | 0.12 | 0.40 | 0.00 | 0.42 | 1.00 | 0.50 | 0.11 |
| His | CAC | 0.61 | 0.88 | 0.60 | 1.00 | 0.58 | 0.00 | 0.50 | 0.89 |
| Ile | ATA | 0.06 | 0.05 | 0.00 | 0.00 | 0.04 | 0.00 | 0.08 | 0.03 |
| Ile | ATT | 0.42 | 0.53 | 0.38 | 0.14 | 0.53 | 0.73 | 0.38 | 0.22 |
| Ile | ATC | 0.52 | 0.42 | 0.63 | 0.86 | 0.42 | 0.27 | 0.54 | 0.75 |
| Leu | TTG | 0.26 | 0.35 | 0.39 | 0.22 | 0.20 | 0.16 | 0.29 | 0.04 |
| Leu | TTA | 0.09 | 0.01 | 0.00 | 0.00 | 0.03 | 0.00 | 0.05 | 0.01 |
| Leu | CTG | 0.09 | 0.22 | 0.39 | 0.09 | 0.06 | 0.12 | 0.08 | 0.73 |
| Leu | CTA | 0.05 | 0.00 | 0.04 | 0.00 | 0.03 | 0.04 | 0.06 | 0.03 |
| Leu | CTT | 0.37 | 0.31 | 0.13 | 0.04 | 0.39 | 0.36 | 0.20 | 0.05 |
| Leu | CTC | 0.13 | 0.12 | 0.04 | 0.65 | 0.29 | 0.32 | 0.32 | 0.15 |
| Lys | AAG | 0.60 | 0.93 | 0.85 | 1.00 | 0.70 | 0.83 | 0.76 | 0.95 |
| Lys | AAA | 0.40 | 0.07 | 0.15 | 0.00 | 0.30 | 0.17 | 0.24 | 0.05 |
| Met | ATG | 1.00 | 1.00 | 1.00 | 1.00 | 1.00 | 1.00 | 1.00 | 1.00 |
| Phe | TTT | 0.37 | 0.21 | 0.25 | 0.20 | 0.31 | 0.78 | 0.38 | 0.16 |
| Phe | TTC | 0.63 | 0.79 | 0.75 | 0.80 | 0.69 | 0.22 | 0.62 | 0.84 |
| Pro | CCG | 0.11 | 0.14 | 0.18 | 0.08 | 0.10 | 0.21 | 0.16 | 0.33 |
| Pro | CCA | 0.33 | 0.42 | 0.09 | 0.08 | 0.16 | 0.29 | 0.31 | 0.08 |
| Pro | CCT | 0.32 | 0.22 | 0.41 | 0.25 | 0.35 | 0.21 | 0.31 | 0.13 |
| Pro | CCC | 0.24 | 0.22 | 0.32 | 0.58 | 0.39 | 0.29 | 0.23 | 0.47 |
| Ser | AGT | 0.12 | 0.13 | 0.09 | 0.00 | 0.09 | 0.13 | 0.18 | 0.04 |
| Ser | AGC | 0.09 | 0.24 | 0.14 | 0.13 | 0.08 | 0.28 | 0.11 | 0.35 |
| Ser | TCG | 0.13 | 0.03 | 0.05 | 0.00 | 0.15 | 0.25 | 0.17 | 0.25 |
| Ser | TCA | 0.12 | 0.25 | 0.05 | 0.00 | 0.12 | 0.08 | 0.12 | 0.05 |
| Ser | TCT | 0.30 | 0.16 | 0.23 | 0.13 | 0.39 | 0.25 | 0.23 | 0.07 |
| Ser | TCC | 0.24 | 0.19 | 0.45 | 0.75 | 0.18 | 0.03 | 0.19 | 0.25 |
| Thr | ACG | 0.09 | 0.14 | 0.10 | 0.28 | 0.10 | 0.18 | 0.21 | 0.30 |
| Thr | ACA | 0.15 | 0.28 | 0.10 | 0.00 | 0.15 | 0.09 | 0.19 | 0.08 |
| Thr | ACT | 0.39 | 0.12 | 0.10 | 0.17 | 0.33 | 0.41 | 0.28 | 0.10 |
| Thr | ACC | 0.37 | 0.47 | 0.70 | 0.56 | 0.43 | 0.32 | 0.32 | 0.52 |
| Trp | TGG | 1.00 | 1.00 | 1.00 | 1.00 | 1.00 | 1.00 | 1.00 | 1.00 |
| Tyr | TAT | 0.38 | 0.32 | 0.20 | 0.00 | 0.38 | 0.20 | 0.39 | 0.10 |
| Tyr | TAC | 0.62 | 0.68 | 0.80 | 1.00 | 0.62 | 0.80 | 0.61 | 0.90 |
| Val | GTG | 0.11 | 0.65 | 0.67 | 0.31 | 0.16 | 0.18 | 0.29 | 0.67 |

TABLE 24C-continued

| Amino Acid | Codon | Cylindrotheca fusiformis | Amphidinium carterae | Symbiodinium microadriacticum | Nannochloropsis sp | Cyclotella cryptica | Navicula pelliculosa | Thalassiosira pseudonana | C. reinhardtii |
|---|---|---|---|---|---|---|---|---|---|
| Val | GTA | 0.06 | 0.05 | 0.00 | 0.00 | 0.09 | 0.09 | 0.16 | 0.03 |
| Val | GTT | 0.38 | 0.08 | 0.11 | 0.15 | 0.42 | 0.09 | 0.28 | 0.07 |
| Val | GTC | 0.46 | 0.21 | 0.22 | 0.54 | 0.33 | 0.64 | 0.27 | 0.22 |

TABLE 24D

| Amino Acid | Codon | Yarrowia lipolytica | Mortierella alpina | Rhodococcus opacus |
|---|---|---|---|---|
| Ala | GCG | 0.08 | 0.14 | 0.35 |
| Ala | GCA | 0.11 | 0.12 | 0.14 |
| Ala | GCT | 0.35 | 0.29 | 0.09 |
| Ala | GCC | 0.46 | 0.45 | 0.43 |
| Arg | AGG | 0.05 | 0.05 | 0.05 |
| Arg | AGA | 0.13 | 0.06 | 0.02 |
| Arg | CGG | 0.12 | 0.06 | 0.26 |
| Arg | CGA | 0.52 | 0.09 | 0.12 |
| Arg | CGT | 0.11 | 0.32 | 0.11 |
| Arg | CGC | 0.07 | 0.42 | 0.44 |
| Asn | AAT | 0.17 | 0.15 | 0.21 |
| Asn | AAC | 0.83 | 0.85 | 0.79 |
| Asp | GAT | 0.35 | 0.42 | 0.24 |
| Asp | GAC | 0.65 | 0.58 | 0.76 |
| Cys | TGT | 0.46 | 0.13 | 0.26 |
| Cys | TGC | 0.54 | 0.87 | 0.74 |
| End | TGA | 0.16 | 0.05 | 0.72 |
| End | TAG | 0.38 | 0.25 | 0.17 |
| End | TAA | 0.46 | 0.70 | 0.11 |
| Gln | CAG | 0.33 | 0.36 | 0.28 |
| Gln | CAA | 0.08 | 0.06 | 0.06 |
| Glu | GAG | 0.44 | 0.49 | 0.45 |
| Glu | GAA | 0.14 | 0.09 | 0.22 |
| Gly | GGG | 0.05 | 0.03 | 0.18 |
| Gly | GGA | 0.28 | 0.29 | 0.15 |
| Gly | GGT | 0.32 | 0.32 | 0.20 |
| Gly | GGC | 0.34 | 0.36 | 0.48 |
| His | CAT | 0.34 | 0.27 | 0.20 |
| His | CAC | 0.66 | 0.73 | 0.80 |
| Ile | ATA | 0.03 | 0.01 | 0.05 |
| Ile | ATT | 0.44 | 0.33 | 0.14 |
| Ile | ATC | 0.53 | 0.66 | 0.81 |
| Leu | TTG | 0.09 | 0.27 | 0.09 |
| Leu | TTA | 0.02 | 0.00 | 0.01 |
| Leu | CTG | 0.37 | 0.26 | 0.41 |
| Leu | CTA | 0.05 | 0.02 | 0.03 |
| Leu | CTT | 0.18 | 0.12 | 0.06 |
| Leu | CTC | 0.29 | 0.32 | 0.40 |
| Lys | AAG | 0.84 | 0.91 | 0.80 |
| Lys | AAA | 0.16 | 0.09 | 0.20 |
| Met | ATG | 1.00 | 1.00 | 1.00 |
| Phe | TTT | 0.38 | 0.39 | 0.09 |
| Phe | TTC | 0.62 | 0.61 | 0.91 |
| Pro | CCG | 0.10 | 0.07 | 0.52 |
| Pro | CCA | 0.10 | 0.08 | 0.09 |
| Pro | CCT | 0.32 | 0.36 | 0.07 |
| Pro | CCC | 0.47 | 0.49 | 0.32 |
| Ser | AGT | 0.07 | 0.05 | 0.08 |
| Ser | AGC | 0.11 | 0.14 | 0.23 |
| Ser | TCG | 0.16 | 0.32 | 0.33 |
| Ser | TCA | 0.08 | 0.08 | 0.07 |
| Ser | TCT | 0.28 | 0.12 | 0.05 |
| Ser | TCC | 0.30 | 0.29 | 0.24 |
| Thr | ACG | 0.11 | 0.17 | 0.28 |
| Thr | ACA | 0.14 | 0.10 | 0.11 |
| Thr | ACT | 0.26 | 0.23 | 0.07 |
| Thr | ACC | 0.49 | 0.49 | 0.53 |
| Trp | TGG | 1.00 | 1.00 | 1.00 |
| Tyr | TAT | 0.18 | 0.20 | 0.18 |
| Tyr | TAC | 0.82 | 0.80 | 0.82 |
| Val | GTG | 0.33 | 0.22 | 0.37 |
| Val | GTA | 0.05 | 0.02 | 0.05 |

TABLE 24D-continued

| Amino Acid | Codon | Yarrowia lipolytica | Mortierella alpina | Rhodococcus opacus |
|---|---|---|---|---|
| Val | GTC | 0.26 | 0.27 | 0.10 |
| Val | GTC | 0.36 | 0.49 | 0.49 |

TABLE 24E

| Preferred codon usage in Chlorella protothecoides | | | |
|---|---|---|---|
| TTC (Phe) | TAC (Tyr) | TGC (Cys) | TGA (Stop) |
| TGG (Trp) | CCC (Pro) | CAC (His) | CGC (Arg) |

TABLE 24E-continued

| Preferred codon usage in Chlorella protothecoides | | | |
|---|---|---|---|
| CTG (Leu) | CAG (Gln) | ATC (Ile) | ACC (Thr) |
| GAC (Asp) | TCC (Ser) | ATG (Met) | AAG (Lys) |
| GCC (Ala) | AAC (Asn) | GGC (Gly) | GTG (Val) |
| GAG (Glu) | | | |

TABLE 25

Lipid biosynthesis pathway proteins.

3-Ketoacyl ACP synthase

*Cuphea hookeriana* 3-ketoacyl-ACP synthase (GenBank Acc. No. AAC68861.1), *Cuphea wrightii* beta-ketoacyl-ACP synthase II (GenBank Acc. No. AAB37271.1), *Cuphea lanceolata* beta-ketoacyl-ACP synthase IV (GenBank Acc. No. CAC59946.1), *Cuphea wrightii* beta-ketoacyl-ACP synthase II (GenBank Acc. No. AAB37270.1), *Ricinus communis* ketoacyl-ACP synthase (GenBank Acc. No. XP_002516228), *Gossypium hirsutum* ketoacyl-ACP synthase (GenBank Acc. No. ADK23940.1), *Glycine max* plastid 3-keto-acyl-ACP synthase II-A (GenBank Acc No. AAW88763.1), *Elaeis guineensis* beta-ketoacyl-ACP synthase II (GenBank Acc. No. AAF26738.2), *Helianthus annuus* plastid 3-keto-acyl-ACP synthase I (GenkBank Acc. No. ABM53471.1), *Glycine max* 3-keto-acyl-ACP synthase I (GenkBank Acc. No. NP_001238610.1), *Helianthus annuus* plastid 3-keto-acyl-ACP synthase II (GenBank Acc ABI18155.1), *Brassica napus* beta-ketoacyl-ACP synthetase 2 (GenBank Acc. No. AAF61739.1), *Perilla frutescens* beta-ketoacyl-ACP synthase II (GenBank Acc. No. AAC04692.1), *Helianthus annus* beta-ketoacyl-ACP synthase II (GenBank Accession No. ABI18155), *Ricinus communis* beta-ketoacyl-ACP synthase II (GenBank Accession No. AAA33872), *Haematococcus pluvialis* beta-ketoacyl acyl carrier protein synthase (GenBank Accession No. HM560033.1), *Jatropha curcasbeta* ketoacyl-ACP synthase I (GenBank Accession No. ABJ90468.1), *Populus trichocarpa* beta-ketoacyl-ACP synthase I (GenBank Accession No. XP_002303661.1), *Coriandrum sativum* beta-ketoacyl-ACP synthetase I (GenBank Accession No. AAK58535.1), *Arabidopsis thaliana* 3-oxoacyl-[acyl-carrier-protein] synthase I (GenBank Accession No. NP_001190479.1), *Vitis vinifera* 3-oxoacyl-[acyl-carrier-protein] synthase I (GenBank Accession No. XP_002272874.2)

Fatty acyl-ACP Thioesterases

*Umbellularia californica* fatty acyl-ACP thioesterase (GenBank Acc. No. AAC49001), *Cinnamomum camphora* fatty acyl-ACP thioesterase (GenBank Acc. No. Q39473), *Umbellularia californica* fatty acyl-ACP thioesterase (GenBank Acc. No. Q41635), *Myristica fragrans* fatty acyl-ACP thioesterase (GenBank Acc. No. AAB71729), *Myristica fragrans* fatty acyl-ACP thioesterase (GenBank Acc. No. AAB71730), *Elaeis guineensis* fatty acyl-ACP thioesterase (GenBank Acc. No. ABD83939), *Elaeis guineensis* fatty acyl-ACP thioesterase (GenBank Acc. No. AAD42220), *Populus tomentosa* fatty acyl-ACP thioesterase (GenBank Acc. No. ABC47311), *Arabidopsis thaliana* fatty acyl-ACP thioesterase (GenBank Acc. No. NP_172327), *Arabidopsis thaliana* fatty acyl-ACP thioesterase (GenBank Acc. No. CAA85387), *Arabidopsis thaliana* fatty acyl-ACP thioesterase (GenBank Acc. No. CAA85388), *Gossypium hirsutum* fatty acyl-ACP thioesterase (GenBank Acc. No. Q9SQI3), *Cuphea lanceolata* fatty acyl-ACP thioesterase (GenBank Acc. No. CAA54060), *Cuphea hookeriana* fatty acyl-ACP thioesterase (GenBank Acc. No. AAC72882), *Cuphea calophylla* subsp. *mesostemon* fatty acyl-ACP thioesterase (GenBank Acc. No. ABB71581), *Cuphea lanceolata* fatty acyl-ACP thioesterase (GenBank Acc. No. CAC19933), *Elaeis guineensis* fatty acyl-ACP thioesterase (GenBank Acc. No. AAL15645), *Cuphea hookeriana* fatty acyl-ACP thioesterase (GenBank Acc. No. Q39513), *Gossypium hirsutum* fatty acyl-ACP thioesterase (GenBank Acc. No. AAD01982), *Vitis vinifera* fatty acyl-ACP thioesterase (GenBank Acc. No. CAN81819), *Garcinia mangostana* fatty acyl-ACP thioesterase (GenBank Acc. No. AAB51525), *Brassica juncea* fatty acyl-ACP thioesterase (GenBank Acc. No. ABI18986), *Madhuca longifolia* fatty acyl-ACP thioesterase (GenBank Acc. No. AAX51637), *Brassica napus* fatty acyl-ACP thioesterase (GenBank Acc. No. ABH11710), *Brassica napus* fatty acyl-ACP thioesterase (GenBank Acc. No. CAA52070.1), *Oryza sativa* (indica cultivar-group) fatty acyl-ACP thioesterase (GenBank Acc. No. EAY86877), *Oryza sativa* (japonica cultivar-group) fatty acyl-ACP thioesterase (GenBank Acc. No. NP_001068400), *Oryza sativa* (indica cultivar-group) fatty acyl-ACP thioesterase (GenBank Acc. No. EAY99617), *Cuphea hookeriana* fatty acyl-ACP thioesterase (GenBank Acc. No. AAC49269), *Ulmus Americana* fatty acyl-ACP thioesterase (GenBank Acc. No. AAB71731), *Cuphea lanceolata* fatty acyl-ACP thioesterase (GenBank Acc. No. CAB60830), *Cuphea palustris* fatty acyl-ACP thioesterase (GenBank Acc. No. AAC49180), *Iris germanica* fatty acyl-ACP thioesterase (GenBank Acc. No. AAG43858, *Iris germanica* fatty acyl-ACP

TABLE 25-continued

Lipid biosynthesis pathway proteins.

thioesterase (GenBank Acc. No. AAG43858.1), *Cuphea palustris* fatty acyl-ACP thioesterase (GenBank Acc. No. AAC49179), *Myristica fragrans* fatty acyl-ACP thioesterase (GenBank Acc. No. AAB71729), *Myristica fragrans* fatty acyl-ACP thioesterase (GenBank Acc. No. AAB717291.1), *Cuphea hookeriana* fatty acyl-ACP thioesterase GenBank Acc. No. U39834), *Umbelluaria californica* fatty acyl-ACP thioesterase (GenBank Acc. No. M94159), *Cinnamomum camphora* fatty acyl-ACP thioesterase (GenBank Acc. No. U31813), *Ricinus communis* fatty acyl-ACP thioesterase (GenBank Acc. No. ABS30422.1), *Helianthus annuus* acyl-ACP thioesterase (GenBank Accession No. AAL79361.1), *Jatropha curcas* acyl-ACP thioesterase (GenBank Accession No. ABX82799.3), *Zea mays* oleoyl-acyl carrier protein thioesterase, (GenBank Accession No. ACG40089.1), *Haematococcus pluvialis* fatty acyl-ACP thioesterase (GenBank Accession No. HM560034.1)

Desaturase Enzymes

*Linum usitatissimum* fatty acid desaturase 3C, (GenBank Acc. No. ADV92272.1), *Ricinus communis* omega-3 fatty acid desaturase, endoplasmic reticulum, putative, (GenBank Acc. No. EEF36775.1), *Vernicia fordii* omega-3 fatty acid desaturase, (GenBank Acc. No. AAF12821), *Glycine max* chloroplast omega 3 fatty acid desaturase isoform 2, (GenBank Acc. No. ACF19424.1), *Prototheca moriformis* FAD-D omega 3 desaturase (SEQ ID NO: 155), *Prototheca moriformis* linoleate desaturase (SEQ ID NO: 156), *Carthamus tinctorius* delta 12 desaturase, (GenBank Accession No. ADM48790.1), *Gossypium hirsutum* omega-6 desaturase, (GenBank Accession No. CAA71199.1), *Glycine max* microsomal desaturase (GenBank Accession No. BAD89862.1), *Zea mays* fatty acid desaturase (GenBank Accession No. ABF50053.1), *Brassica napa* linoleic acid desaturase (GenBank Accession No. AAA32994.1), *Camelina sativa* omega-3 desaturase (SEQ ID NO: 157), *Prototheca moriformis* delta 12 desaturase allele 2 (SEQ ID NO: 158, *Camelina sativa* omega-3 FAD7-1 (SEQ ID NO: 159), *Helianthus annuus* stearoyl-ACP desaturase, (GenBank Accession No. AAB65145.1), *Ricinus communis* stearoyl-ACP desaturase, (GenBank Accession No. AACG59946.1), *Brassica juncea* plastidic delta-9-stearoyl-ACP desaturase (GenBank Accession No. AAD40245.1), *Glycine max* stearoyl-ACP desaturase (GenBank Accession No. ACJ39209.1), *Olea europaea* stearoyl-ACP desaturase (GenBank Accession No. AAB67840.1), *Vernicia fordii* stearoyl-acyl-carrier protein desaturase, (GenBank Accession No. ADC32803.1), *Descurainia sophia* delta-12 fatty acid desaturase (GenBank Accession No. ABS86964.2), *Euphorbia lagascae* delta12-oleic acid desaturase (GenBank Acc. No. AAS57577.1), *Chlorella vulgaris* delta 12 fatty acid desaturease (GenBank Accession No. ACF98528), *Chlorella vulgaris* omega-3 fatty acid desaturease (GenBank Accession No. BAB78717), *Haematococcus pluvialis* omega-3 fatty acid desaturase (GenBank Accession No. HM560035.1), *Haematococcus pluvialis* stearoyl-ACP-desaturase GenBank Accession No. EF586860.1, *Haematococcus pluvialis* stearoyl-ACP-desaturase GenBank Accession No. EF523479.1

Oleate 12-hydroxylase Enzymes

*Ricinus communis* oleate 12-hydroxylase (GenBank Acc. No. AAC49010.1), *Physaria lindheimeri* oleate 12-hydroxylase (GenBank Acc. No. ABQ01458.1), *Physaria lindheimeri* mutant bifunctional oleate 12-hydroxylase:desaturase (GenBank Acc. No. ACF17571.1), *Physaria lindheimeri* bifunctional oleate 12-hydroxylase:desaturase (GenBank Accession No. ACQ42234.1), *Physaria lindheimeri* bifunctional oleate 12-hydroxylase:desaturase (GenBank Acc. No. AAC32755.1), *Arabidopsis lyrata* subsp. *Lyrata* (GenBank Acc. No. XP_002884883.1)

Glycerol-3-phosphate Enzymes

*Arabidopsis thaliana* glycerol-3-phosphate acyltransferase BAA00575, *Chlamydomonas reinhardtii* glycerol-3-phosphate acyltransferase (GenBank Acc. No. EDP02129), *Chlamydomonas reinhardtii* glycerol-3-phosphate acyltransferase (GenBank Acc. No. Q886Q7), *Cucurbita moschata* acyl-(acyl-carrier-protein):glycerol-3-phosphate acyltransferase (GenBank Acc. No. BAB39688), *Elaeis guineensis* glycerol-3-phosphate acyltransferase, ((GenBank Acc. No. AAF64066), *Garcina mangostana* glycerol-3-phosphate acyltransferase (GenBank Acc. No. ABS86942), *Gossypium hirsutum* glycerol-3-phosphate acyltransferase (GenBank Acc. No. ADK23938), *Jatropha curcas* glycerol-3-phosphate acyltransferase (GenBank Acc. No. ADV77219), *Jatropha curcas* plastid glycerol-3-phosphate acyltransferase (GenBank Acc. No. ACR61638), *Ricinus communis* plastidial glycerol-phosphate acyltransferase (GenBank Acc. No. EEF43526), *Vica faba* glycerol-3-phosphate acyltransferase (GenBank Accession No. AAD05164), *Zea mays* glycerol-3-phosphate acyltransferase (GenBank Acc. No. ACG45812)

Lysophosphatidic acid acyltransferase Enzymes

*Arabidopsis thaliana* 1-acyl-sn-glycerol-3-phosphate acyltransferase (GenBank Accession No. AEE85783), *Brassica juncea* 1-acyl-sn-glycerol-3-phosphate acyltransferase (GenBank Accession No. ABQ42862), *Brassica juncea* 1-acyl-sn-glycerol-3-phosphate acyltransferase (GenBank Accession No. ABM92334), *Brassica napus* 1-acyl-sn-glycerol-3-phosphate acyltransferase (GenBank Accession No. CAB09138), *Chlamydomonas reinhardtii* lysophosphatidic acid acyltransferase (GenBank Accession No. EDP02300), *Cocos nucifera* lysophosphatidic acid acyltransferase (GenBank Acc. No. AAC49119), *Limnanthes alba* lysophosphatidic acid acyltransferase (GenBank Accession No. EDP02300), *Limnanthes douglasii* 1-acyl-sn-glycerol-3-phosphate acyltransferase (putative) (GenBank Accession No. CAA88620), *Limnanthes douglasii* acyl-CoA:sn-1-acylglycerol-3-phosphate acyltransferase (GenBank Accession No. ABD62751), *Limnanthes douglasii* 1-acylglycerol-3-phosphate O-acyltransferase (GenBank Accession No. CAA58239), *Ricinus communis* 1-acyl-sn-glycerol-3-phosphate acyltransferase (GenBank Accession No. EEF39377)

TABLE 25-continued

Lipid biosynthesis pathway proteins.

Diacylglycerol acyltransferase Enzymes

*Arabidopsis thaliana* diacylglycerol acyltransferase (GenBank Acc. No. CAB45373),
*Brassica juncea* diacylglycerol acyltransferase (GenBank Acc. No. AAY40784), *Elaeis guineensis* putative diacylglycerol acyltransferase (GenBank Acc. No. AEQ94187),
*Elaeis guineensis* putative diacylglycerol acyltransferase (GenBank Acc. No. AEQ94186),
*Glycine max* acyl CoA:diacylglycerol acyltransferase (GenBank Acc. No. AAT73629),
*Helianthus annus* diacylglycerol acyltransferase (GenBank Acc. No. ABX61081), *Olea europaea* acyl-CoA:diacylglycerol acyltransferase 1 (GenBank Acc. No. AAS01606),
*Ricinus communis* diacylglycerol acyltransferase (GenBank Acc. No. AAR11479)

Phospholipid diacylglycerol acyltransferase Enzymes

*Arabidopsis thaliana* phospholipid:diacylglycerol acyltransferase (GenBank Acc. No. AED91921), *Elaeis guineensis* putative phospholipid:diacylglycerol acyltransferase (GenBank Acc. No. AEQ94116), *Glycine max* phospholipid:diacylglycerol acyltransferase 1-like (GenBank Acc. No. XP_003541296), *Jatropha curcas* phospholipid:diacylglycerol acyltransferase (GenBank Acc. No. AEZ56255), *Ricinus communis* phospholipid:diacylglycerol acyltransferase (GenBank Acc. No. ADK92410), *Ricinus communis* phospholipid:diacylglycerol acyltransferase (GenBank Acc. No. AEW99982)

Example 10

Engineering *Chlorella Sorokiniana*

Expression of recombinant genes in accordance with the present invention in *Chlorella sorokiniana* may be accomplished by modifying the methods and vectors taught by Dawson et al. as discussed herein. Briefly, Dawson et al., *Current Microbiology* Vol. 35 (1997) pp. 356-362, reported the stable nuclear transformation of *Chlorella sorokiniana* with plasmid DNA. Using the transformation method of microprojectile bombardment, Dawson introduced the plasmid pSV72-NRg, encoding the full *Chlorella vulgaris* nitrate reductase gene (NR, GenBank Accession No. U39931), into mutant *Chlorella sorokiniana* (NR-mutants). The NR-mutants are incapable of growth without the use of nitrate as a source of nitrogen. Nitrate reductase catalyzes the conversion of nitrate to nitrite. Prior to transformation, *Chlorella sorokiniana* NR-mutants were unable to grow beyond the microcolony stage on culture medium comprising nitrate ($NO_3^-$) as the sole nitrogen source. The expression of the *Chlorella vulgaris* NR gene product in NR-mutant *Chlorella sorokiniana* was used as a selectable marker to rescue the nitrate metabolism deficiency. Upon transformation with the pSV72-NRg plasmid, NR-mutant *Chlorella sorokiniana* stably expressing the *Chlorella vulgaris* NR gene product were obtained that were able to grow beyond the microcolony stage on agar plates comprising nitrate as the sole carbon source. Evaluation of the DNA of the stable transformants was performed by Southern analysis and evaluation of the RNA of the stable transformants was performed by RNase protection. Selection and maintenance of the transformed *Chlorella sorokiniana* (NR mutant) was performed on agar plates (pH 7.4) comprising 0.2 g/L $MgSO_4$, 0.67 g/L $KH_2PO_4$, 3.5 g/L $K_2HPO_4$, 1.0 g/L $Na_3C_6H_5O_7 \cdot H_2O$ and 16.0 g/L agar, an appropriate nitrogen source (e.g., $NO_3^-$), micronutrients, and a carbon source. Dawson also reported the propagation of *Chlorella sorokiniana* and *Chlorella sorokiniana* NR mutants in liquid culture medium. Dawson reported that the plasmid pSV72-NRg and the promoter and 3' UTR/terminator of the *Chlorella vulgaris* nitrate reductase gene were suitable to enable heterologous gene expression in *Chlorella sorokiniana* NR-mutants. Dawson also reported that expression of the *Chlorella vulgaris* nitrate reductase gene product was suitable for use as a selectable marker in *Chlorella sorokiniana* NR-mutants.

In an embodiment of the present invention, vector pSV72-NRg, comprising nucleotide sequence encoding the *Chlorella vulgaris* nitrate reductase (CvNR) gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Chlorella sorokiniana* to reflect the codon bias inherent in nuclear genes of *Chlorella sorokiniana* in accordance with Tables 24A-D. For each lipid biosynthesis pathway protein of Table 25, the codon-optimized gene sequence can individually be operably linked to the CvNR promoter upstream of the protein-coding sequence and operably linked to the CvNR 3'UTR/terminator at the 3' region, or downstream, of the protein-coding sequence. The transformation construct may additionally comprise homology regions to the *Chlorella sorokiniana* genome for targeted genomic integration of the transformation vector. Homology regions may be selected to disrupt one or more genomic sites of endogenous lipid biosynthesis pathway genes. Stable transformation of *Chlorella sorokiniana* with the transformation vector is achieved through well-known transformation techniques including microprojectile bombardment or other known methods. Activity of the CvNR gene product may be used as a selectable marker to rescue the nitrogen assimiliation deficiency of *Chlorella sorokiniana* NR mutant strains and to select for *Chlorella sorokiniana* NR-mutants stably expressing the transformation vector. Growth media suitable for *Chlorella sorokiniana* lipid production include, but are not limited to 0.5 g/L $KH_2PO_4$, 0.5 g/L $K_2HPO_4$, 0.25 g/L $MgSO_4 \cdot 7H_2O$, with supplemental micronutrients and the appropriate nitrogen and carbon sources (Patterson, *Lipids* Vol. 5:7 (1970), pp. 597-600). Evaluation of fatty acid profiles of *Chlorella sorokiniana* lipids may be assessed through standard lipid extraction and analytical methods described herein.

Example 11

Engineering *Chlorella Vulgaris*

Expression of recombinant genes in accordance with the present invention in *Chlorella vulgaris* may be accomplished by modifying the methods and vectors taught by Chow and Tung et al. as discussed herein. Briefly, Chow and Tung et al., Plant Cell Reports, Volume 18 (1999), pp. 778-780, reported the stable nuclear transformation of *Chlorella vulgaris* with plasmid DNA. Using the transformation method of electroporation, Chow and Tung introduced the plasmid pIG121-Hm (GenBank Accession No. AB489142) into *Chlorella vulgaris*. The nucleotide sequence of pIG121-Hm comprised sequence encoding a beta-glucuronidase (GUS) reporter gene product operably-linked to a CaMV 35S promoter upstream of the GUS protein-coding sequence and further operably linked to the 3' UTR/terminator of the nopaline synthase (nos) gene downstream of the GUS protein-coding sequence. The sequence of plasmid pIG121-Hm further comprised a hygromycin B antibiotic resistance cassette. This hygromycin B antibiotic resistance cassette comprised a CaMV 35S promoter operably linked to sequence encoding the hygromycin phosphotransferase (hpt, GenBank Accession No. BAH24259) gene product. Prior to transformation, *Chlorella vulgaris* was unable to be propagated in culture medium comprising 50 ug/ml hygromycin B. Upon transformation with the pIG121-Hm plasmid, transformants of *Chlorella vulgaris* were obtained that were propagated in culture medium comprising 50 ug/ml hyrgromycin B. The expression of the hpt gene product in *Chlorella vulgaris* enabled propagation of transformed *Chlorella vulgaris* in the presence of 50 ug/mL hyrgromycin B, thereby establishing the utility of the a hygromycin B resistance cassette as a selectable marker for use in *Chlorella vulgaris*. Detectable activity of the GUS reporter gene indicated that CaMV 35S promoter and nos 3'UTR are suitable for enabling heterologous gene expression in *Chlorella vulgaris*. Evaluation of the genomic DNA of the stable transformants was performed by Southern analysis. Selection and maintenance of transformed *Chlorella vulgaris* was performed on agar plates comprising YA medium (agar and 4 g/L yeast extract). The propagation of *Chlorella vulgaris* in liquid culture medium was conducted as discussed by Chow and Tung. Propagation of *Chlorella vulgaris* in media other than YA medium has been described (for examples, see Chader et al., *Revue des Energies Renouvelabes*, Volume 14 (2011), pp. 21-26 and Illman et al., *Enzyme and Microbial Technology*, Vol. 27 (2000), pp. 631-635). Chow and Tung reported that the plasmid pIG121-Hm, the CaMV 35S promoter, and the *Agrobacterium tumefaciens* nopaline synthase gene 3'UTR/terminator are suitable to enable heterologous gene expression in *Chlorella vulgaris*. In addition, Chow and Tung reported the hyromycin B resistance cassette was suitable for use as a selectable marker in *Chlorella vulgaris*. Additional plasmids, promoters, 3'UTR/terminators, and selectable markers suitable for enabling heterologous gene expression in *Chlorella vulgaris* have been discussed in Chader et al., *Revue des Energies Renouvelabes*, Volume 14 (2011), pp. 21-26.

In an embodiment of the present invention, pIG121-Hm, comprising the nucleotide sequence encoding the hygromycin B gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Chlorella vulgaris* to reflect the codon bias inherent in nuclear genes of *Chlorella vulgaris* in accordance with Tables 24A-D. For each lipid biosynthesis pathway protein of Table 25, the codon-optimized gene sequence can individually be operably linked to the CaMV 35S promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Chlorella vulgaris* genome for targeted genomic integration of the transformation vector. Homology regions may be selected to disrupt one or more genomic sites of endogenous lipid biosynthesis pathway genes. Stable transformation of *Chlorella vulgaris* with the transformation vector is achieved through well-known transformation techniques including electroporation or other known methods. Activity of the hygromycin B resistance gene product may be used as a marker to select for *Chlorella vulgaris* transformed with the transformation vector on, but not limited to, agar medium comprising hygromycin. Growth media suitable for *Chlorella vulgaris* lipid production include, but are not limited to BG11 medium (0.04 g/L $KH_2PO_4$, 0.075 g/L $CaCl_2$, 0.036 g/L citric acid, 0.006 g/L Ammonium Ferric Citrate, 1 mg/L EDTA, and 0.02 g/L $Na_2CO_3$) supplemented with trace metals, and optionally 1.5 g/L NaNO3. Additional media suitable for culturing *Chlorella vulgaris* for lipid production include, for example, Watanabe medium (comprising 1.5 g/L $KNO_3$, 1.25 g/L $KH_2PO_4$, 1.25 g $l^{-1}$ $MgSO_4.7H_2O$, 20 mg $l^{-1}$ $FeSO_4.7H_2O$ with micronutrients and low-nitrogen medium (comprising 203 mg/l $(NH_4)_2HPO_4$, 2.236 g/l KCl, 2.465 g/l $MgSO_4$, 1.361 g/l $KH_2PO_4$ and 10 mg/l $FeSO_4$) as reported by Illman et al., *Enzyme and Microbial Technology*, Vol. 27 (2000), pp. 631-635. Evaluation of fatty acid profiles of *Chlorella vulgaris* lipids may be assessed through standard lipid extraction and analytical methods described herein.

Example 12

Engineering *Chlorella Ellipsoidea*

Expression of recombinant genes in accordance with the present invention in *Chlorella ellipsoidea* may be accomplished by modifying the methods and vectors taught by Chen et al. as discussed herein. Briefly, Chen et al., *Current Genetics*, Vol. 39:5 (2001), pp. 365-370, reported the stable transformation of *Chlorella ellipsoidea* with plasmid DNA. Using the transformation method of electroporation, Chen introduced the plasmid pBinUΩNP-1 into *Chlorella ellipsoidea*. The nucleotide sequence of pBinUΩNP-1 comprised sequence encoding the neutrophil peptide-1 (NP-1) rabbit gene product operably linked to a *Zea mays* Ubiquitin (ubi1) gene promoter upstream of the NP-1 protein-coding region and operably linked to the 3' UTR/terminator of the nopaline synthase (nos) gene downstream of the NP-1 protein-coding region. The sequence of plasmid pBinUΩNP-1 further comprised a G418 antibiotic resistance cassette. This G418 antibiotic resistance cassette comprised sequence encoding the aminoglycoside 3'-phosphotransferase (aph 3') gene product. The aph 3' gene product confers resistance to the antibiotic G418. Prior to transformation, *Chlorella ellipsoidea* was unable to be propagated in culture medium comprising 30 ug/mL G418. Upon transformation with the pBinUΩNP-1 plasmid, transformants of *Chlorella ellipsoidea* were obtained that were propagated in selective culture medium comprising 30 ug/mL G418. The expression of the aph 3' gene product in *Chlorella ellipsoidea* enabled propagation of transformed *Chlorella ellipsoidea* in the presence of 30 ug/mL G418, thereby establishing the utility of the G418 antibiotic resistance cassette as selectable marker for use in *Chlorella ellipsoidea*. Detectable activity of the NP-1 gene product indicated that the ubi1 promoter and nos 3' UTR are suitable for enabling heterologous gene expression in *Chlorella ellipsoidea*. Evaluation of the genomic DNA of the stable transformants was performed by Southern analysis. Selection and maintenance of the transformed *Chlorella ellipsoidea* was performed on Knop medium (comprising 0.2 g/L K$_2$HPO$_4$, 0.2 g/L MgSO$_4$.7H$_2$O, 0.12 g/L KCl, and 10 mg/L FeCl3, pH 6.0-8.0 supplemented with 0.1% yeast extract and 0.2% glucose) with 15 ug/mL G418 (for liquid cultures) or with 30 ug/mL G418 (for solid cultures comprising 1.8% agar). Propagation of *Chlorella ellipsoidea* in media other than Knop medium has been reported (see Cho et al., Fisheries Science, Vol. 73:5 (2007), pp. 1050-1056, Jarvis and Brown, *Current Genetics*, Vol. 19 (1991), pp. 317-321 and Kim et al., *Marine Biotechnology*, Vol. 4 (2002), pp. 63-73). Additional plasmids, promoters, 3'UTR/terminators, and selectable markers suitable for enabling heterologous gene expression in *Chlorella ellipsoidea* have been reported (see Jarvis and Brown and Kim et al., *Marine Biotechnology*, Vol. 4 (2002), pp. 63-73). Chen reported that the plasmid pBinUΩNP-1, the ubi1 promoter, and the *Agrobacterium tumefaciens* nopaline synthase gene 3'UTR/terminator are suitable to enable exogenous gene expression in *Chlorella ellipsoidea*. In addition, Chen reported that the G418 resistance cassette encoded on pBinUΩNP-1 was suitable for use as a selectable marker in *Chlorella ellipsoidea*.

In an embodiment of the present invention, vector pBinUΩNP-1, comprising the nucleotide sequence encoding the aph 3' gene product, conferring resistance to G418, for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Chlorella ellipsoidea* to reflect the codon bias inherent in nuclear genes of *Chlorella ellipsoidea* in accordance with Tables 24A-D. For each lipid biosynthesis pathway protein of Table 25, the codon-optimized gene sequence can individually be operably linked to the *Zea mays* ubi1 promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Chlorella ellipsoidea* genome for targeted genomic integration of the transformation vector. Homology regions may be selected to disrupt one or more genomic sites of endogenous lipid biosynthesis pathway genes. Stable transformation of *Chlorella ellipsoidea* with the transformation vector is achieved through well-known transformation techniques including electroporation or other known methods. Activity of the aph 3' gene product may be used as a marker to select for *Chlorella ellipsoidea* transformed with the transformation vector on, but not limited to, Knop agar medium comprising G418. Growth media suitable for *Chlorella ellipsoidea* lipid production include, but are not limited to, Knop medium and those culture medium reported by Jarvis and Brown and Kim et al. Evaluation of fatty acid profiles of *Chlorella ellipsoidea* lipids may be assessed through standard lipid extraction and analytical methods described herein.

Example 13

Engineering *Chlorella Kessleri*

Expression of recombinant genes in accordance with the present invention in *Chlorella kessleri* may be accomplished by modifying the methods and vectors taught by El-Sheekh et al. as discussed herein. Briefly, El-Sheekh et al., *Biologia Plantarium*, Vol. 42:2 (1999), pp. 209-216, reported the stable transformation of *Chlorella kessleri* with plasmid DNA. Using the transformation method of microprojectile bombardment, El-Sheekh introduced the plasmid pBI121 (GenBank Accession No. AF485783) into *Chlorella kessleri*. Plasmid pBI121 comprised a kanamycin/neomycin antibiotic resistance cassette. This kanamycin/neomycin antibiotic resistance cassette comprised the *Agrobacterium tumefaciens* nopaline synthase (nos) gene promoter, sequence encoding the neomycin phosphotransferase II (nptII) gene product (GenBank Accession No. AAL92039) for resistance to kanamycin and G418, and the 3' UTR/terminator of the *Agrobacterium tumefaciens* nopaline synthase (nos) gene. pBI121 further comprised sequence encoding a beta-glucuronidase (GUS) reporter gene product operably linked to a CaMV 35S promoter and operably linked to a 3' UTR/terminator of the nos gene. Prior to transformation, *Chlorella kessleri* was unable to be propagated in culture medium comprising 15 ug/L kanamycin. Upon transformation with the pBI121 plasmid, transformants of *Chlorella kessleri* were obtained that were propagated in selective culture medium comprising 15 mg/L kanamycin. The expression of the nptII gene product in *Chlorella kessleri* enabled propagation in the presence of 15 mg/L kanamycin, thereby establishing the utility of the kanamycin/neomycin antibiotic resistance cassette as selectable marker for use in *Chlorella kessleri*. Detectable activity of the GUS gene product indicated that the CaMV 35S promoter and nos 3' UTR are suitable for enabling heterologous gene expression in *Chlorella kessleri*. Evaluation of the genomic DNA of the stable transformants was performed by Southern analysis. As reported by El-Sheekh, selection and maintenance of transformed *Chlorella kessleri* was conducted on semisolid agar plates comprising YEG medium (1% yeast extract, 1% glucose) and 15 mg/L kanamycin. El-Sheekh also reported the propagation of *Chlorella kessleri* in YEG liquid culture media. Additional media suitable for culturing *Chlorella kessleri* for lipid production are disclosed in Sato et al., *BBA Molecular and Cell Biology of Lipids*, Vol. 1633 (2003), pp. 27-34). El-Sheekh reported that the plasmid pBI121, the CaMV promoter, and the nopaline synthase gene 3'UTR/terminator are suitable to enable heterologous gene expression in *Chlorella kessleri*. In addition, El-Sheekh reported that the kanamycin/neomycin resistance cassette encoded on pBI121 was suitable for use as a selectable marker in *Chlorella kessleri*.

In an embodiment of the present invention, vector pBI121, comprising the nucleotide sequence encoding the kanamycin/neomycin resistance gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Chlorella kessleri* to reflect the codon bias inherent in nuclear genes of *Chlorella kessleri* in accordance with Tables 24A-D. For each lipid biosynthesis pathway protein of Table 25, the codon-optimized gene sequence can individually be operably linked to the CaMV 35S promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Chlorella kessleri* genome for targeted genomic integration of the transformation vector. Homology regions may be selected to disrupt one or more genomic sites of endogenous lipid biosynthesis pathway genes. Stable transformation of *Chlorella kessleri* with the transformation vector is achieved through well-known transformation techniques including microprojectile bombardment or other known methods. Activity of the nptII gene product may be used as a marker to select for *Chlorella kessleri* transformed with the transformation vector on, but not limited to, YEG agar medium comprising kanamycin or neomycin. Growth media suitable for *Chlorella kessleri* lipid production include, but are not limited to, YEG medium, and those culture media reported by Sato et al. Evaluation of fatty acid profiles of *Chlorella kessleri* lipids may be assessed through standard lipid extraction and analytical methods described herein.

Example 14

Engineering *Dunaliella Tertiolecta*

Expression of recombinant genes in accordance with the present invention in *Dunaliella tertiolecta* may be accomplished by modifying the methods and vectors taught by Walker et al. as discussed herein. Briefly, Walker et al., *Journal of Applied Phycology*, Vol. 17 (2005), pp. 363-368, reported stable nuclear transformation of *Dunaliella tertiolecta* with plasmid DNA. Using the transformation method of electroporation, Walker introduced the plasmid pDb1eFLAG1.2 into *Dunaliella tertiolecta*. pDb1eFLAG1.2 comprised sequence encoding a bleomycin antibiotic resistance cassette, comprising sequence encoding the *Streptoalloteichus hindustanus* Bleomycin binding protein (ble), for resistance to the antibiotic phleomycin, operably linked to the promoter and 3' UTR of the *Dunaliella tertiolecta* ribulose-1,5-bisphosphate carboxylase/oxygenase small subunit gene (rbcS1, GenBank Accession No. AY530155). Prior to transformation, *Dunaliella tertiolecta* was unable to be propagated in culture medium comprising 1 mg/L phleomycin. Upon transformation with the pDb1eFLAG1.2 plasmid, transformants of *Dunaliella tertiolecta* were obtained that were propagated in selective culture medium comprising 1 mg/L phleomycin. The expression of the ble gene product in *Dunaliella tertiolecta* enabled propagation in the presence of 1 mg/L phleomycin, thereby establishing the utility of the bleomycin antibiotic resistance cassette as selectable marker for use in *Dunaliella tertiolecta*. Evaluation of the genomic DNA of the stable transformants was performed by Southern analysis. As reported by Walker, selection and maintenance of transformed *Dunaliella tertiolecta* was conducted in *Dunaliella* medium (DM, as described by Provasoli et al., *Archiv fur Mikrobiologie*, Vol. 25 (1957), pp. 392-428) further comprising 4.5 g/L NaCl and 1 mg/L pheomycin. Additional media suitable for culturing *Dunaliella tertiolecta* for lipid production are discussed in Takagi et al., *Journal of Bioscience and Bioengineering*, Vol. 101:3 (2006), pp. 223-226 and in Massart and Hanston, Proceedings Venice 2010, *Third International Symposium on Energy from Biomass and Waste*. Walker reported that the plasmid pDb1eFLAG1.2 and the promoter and 3' UTR of the *Dunaliella tertiolecta* ribulose-1,5-bisphosphate carboxylase/oxygenase small subunit gene are suitable to enable heterologous expression in *Dunaliella tertiolecta*. In addition, Walker reported that the bleomycin resistance cassette encoded on pDb1eFLAG1.2 was suitable for use as a selectable marker in *Dunaliella tertiolecta*.

In an embodiment of the present invention, vector pDb1eFLAG1.2, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Dunaliella tertiolecta* to reflect the codon bias inherent in nuclear genes of *Dunaliella tertiolecta* in accordance with Tables 24A-D. For each lipid biosynthesis pathway protein of Table 25, the codon-optimized gene sequence can individually be operably linked to the rbcS1 promoter upstream of the protein-coding sequence and operably linked to the rbcS1 3'UTR/terminator at the 3' region, or downstream, of the protein-coding sequence. The transformation construct may additionally comprise homology regions to the *Dunaliella tertiolecta* genome for targeted genomic integration of the transformation vector. Homology regions may be selected to disrupt one or more genomic sites of endogenous lipid biosynthesis pathway genes. Stable transformation of *Dunaliella tertiolecta* with the transformation vector is achieved through well-known transformation techniques including electroporation or other known methods. Activity of the ble gene product may be used as a marker to select for *Dunaliella tertiolecta* transformed with the transformation vector on, but not limited to, DM medium comprising pheomycin. Growth medium suitable for *Dunaliella tertiolecta* lipid production include, but are not limited to DM medium and those culture media described by Takagi et al. and Massart and Hanston. Evaluation of fatty acid profiles of *Dunaliella tertiolecta* lipids may be assessed through standard lipid extraction and analytical methods described herein.

Example 15

Engineering *Volvox Carteri*

Expression of recombinant genes in accordance with the present invention in *Volvox carteri* may be accomplished by modifying the methods and vectors taught by Hallman and Rappel et al. as discussed herein. Briefly, Hallman and Rappel et al., *The Plant Journal*, Volume 17 (1999), pp. 99-109, reported the stable nuclear transformation of *Volvox carteri* with plasmid DNA. Using the transformation method of microprojectile bombardment, Hallman and Rappel introduced the pzeoE plasmid into *Volvox carteri*. The pzeoE plasmid comprised sequence encoding a bleomycin antibiotic resistance cassette, comprising sequence encoding the *Streptoalloteichus hindustanus* Bleomycin binding protein (ble), for resistance to the antibiotic zeocin, operably linked to and the promoter and 3' UTR of the *Volvox carteri* beta-tubulin gene (GenBank Accession No. L24547). Prior to transformation, *Volvox carteri* was unable to be propagated in culture medium comprising 1.5 ug/ml zeocin. Upon transformation with the pzeoE plasmid, transformants of *Volvox carteri* were obtained that were propagated in selective culture medium comprising greater than 20 ug/ml zeocin. The expression of the ble gene product in *Volvox carteri* enabled propagation in the presence of 20 ug/ml zeocin, thereby establishing the utility of the bleomycin antibiotic resistance cassette as selectable marker for use in *Volvox carteri*. Evaluation of the genomic DNA of the stable transformants was performed by Southern analysis. As reported by Hallman and Rappel, selection and maintenance of transformed *Volvox carteri* was conducted in *Volvox* medium (VM, as described by Provasoli and Pintner, The Ecology of Algae, Special Publication No. 2 (1959), Tyron, C. A. and Hartman, R. T., eds., Pittsburgh: University of Pittsburgh, pp. 88-96) with 1 mg/L pheomycin. Media suitable for culturing *Volvox carteri* for lipid production are also discussed by Starr in Starr R. C., *Dev Biol* Suppl., Vol. 4 (1970), pp. 59-100). Hallman and Rappel reported that the plasmid pzeoE and the promoter and 3' UTR of the *Volvox carteri* beta-tubulin gene are suitable to enable heterologous expression in *Volvox carteri*. In addition, Hallmann and Rappel reported that the bleomycin resistance cassette encoded on pzeoE was suitable for use as a selectable marker in *Volvox carteri*. Additional plasmids, promoters, 3'UTR/terminators, and selectable markers suitable for enabling heterologous gene expression in *Volvox carteri* and suitable for use as selective markers *Volvox carteri* in have been reported (for instance see Hallamann and Sumper, *Proceedings of the National Academy of Sciences*, Vol. 91 (1994), pp 11562-11566 and Hallman and Wodniok, *Plant Cell Reports*, Volume 25 (2006), pp. 582-581).

In an embodiment of the present invention, vector pzeoE, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Volvox carteri* to reflect the codon bias inherent in nuclear genes of *Volvox carteri* in accordance with Tables 24A-D. For each lipid biosynthesis pathway protein of Table 25, the codon-optimized gene sequence can individually be operably linked to the *Volvox carteri* beta-tubulin promoter upstream of the protein-coding sequence and operably linked to the *Volvox carteri* beta-tubulin 3'UTR/terminator at the 3' region, or downstream, of the protein-coding sequence. The transformation construct may additionally comprise homology regions to the *Volvox carteri* genome for targeted genomic integration of the transformation vector. Homology regions may be selected to disrupt one or more genomic sites of endogenous lipid biosynthesis pathway genes. One skilled in the art can identify such homology regions within the sequence of the *Volvox carteri* genome (referenced in the publication by Prochnik et al., *Science*, Vol. 329:5988 (2010), pp 223-226). Stable transformation of *Volvox carteri* with the transformation vector is achieved through well-known transformation techniques including microprojectile bombardment or other known methods. Activity of the ble gene product may be used as a marker to select for *Volvox carteri* transformed with the transformation vector on, but not limited to, VM medium comprising zeocin. Growth medium suitable for *Volvox carteri* lipid production include, but are not limited to VM medium and those culture media discussed by Starr. Evaluation of fatty acid profiles of *Volvox carteri* lipids may be assessed through standard lipid extraction and analytical methods described herein.

Example 16

Engineering *Haematococcus Pluvialis*

Expression of recombinant genes in accordance with the present invention in *Haematococcus pluvialis* may be accomplished by modifying the methods and vectors taught by Steinbrenner and Sandmann et al. as discussed herein. Briefly, Steinbrenner and Sandmann et al., *Applied and Environmental Microbiology*, Vol. 72:12 (2006), pp. 7477-7484, reported the stable nuclear transformation of *Haematococcus pluvialis* with plasmid DNA. Using the transformation method of microprojectile bombardment, Steinbrenner introduced the plasmid pPlat-pds-L504R into *Haematococcus pluvialis*. The plasmid pPlat-pds-L504R comprised a norflurazon resistance cassette, which comprised the promoter, protein-coding sequence, and 3'UTR of the *Haematococcus pluvialis* phytoene desaturase gene (Pds, GenBank Accession No. AY781170), wherein the protein-coding sequence of Pds was modified at position 504 (thereby changing a leucine to an arginine) to encode a gene product (Pds-L504R) that confers resistance to the herbicide norflurazon. Prior to transformation with pPlat-pds-L504R, *Haematococcus pluvialis* was unable to propagate on medium comprising 5 uM norflurazon. Upon transformation with the pPlat-pds-L504R plasmid, transformants of *Haematococcus pluvialis* were obtained that were propagated in selective culture medium comprising 5 uM norflurazon. The expression of the Pds-L504R gene product in *Haematococcus pluvialis* enabled propagation in the presence of 5 uM norflurazon, thereby establishing the utility of the norflurazon herbicide resistance cassette as selectable marker for use in *Haematococcus pluvialis*. Evaluation of the genomic DNA of the stable transformants was performed by Southern analysis. As reported by Steinbrenner, selection and maintenance of transformed *Haematococcus pluvialis* was conducted on agar plates comprising OHA medium (OHM (0.41 g/L $KNO_3$, 0.03 g/L $Na_2HPO_4$, 0.246 g/L $MgSO_4.7H_2O$, 0.11 g/L $CaCl_2.2H_2O$, 2.62 mg/L $Fe_{(III)}$citrate×$H_2O$, 0.011 mg/L $CoCl_2.6H_2O$, 0.012 mg/L $CuSO_4.5H_2O$, 0.075 mg/L $Cr_2O_3$, 0.98 mg/L $MnCl_2.4H_2O$, 0.12 mg/L $Na_2MoO_4×2H_2O$, 0.005 mg/L $SeO_2$ and 25 mg/L biotin, 17.5 mg/L thiamine, and 15 mg/L vitamin B12), supplemented with 2.42 g/L Tris-acetate, and 5 mM norflurazon. Propagation of *Haematococcus pluvialis* in liquid culture was performed by Steinbrenner and Sandmann using basal medium (basal medium as described by Kobayashi et al., *Applied and Environmental Microbiology*, Vol. 59 (1993), pp. 867-873). Steinbrenner and Sandmann reported that the pPlat-pds-L504R plasmid and promoter and 3' UTR of the *Haematococcus pluvialis* phytoene desaturase gene are suitable to enable heterologous expression in *Haematococcus pluvialis*. In addition, Steinbrenner and Sandmann reported that the norflurazon resistance cassette encoded on pPlat-pds-L504R was suitable for use as a selectable marker in *Haematococcus pluvialis*. Additional plasmids, promoters, 3'UTR/terminators, and selectable markers suitable for enabling heterologous gene expression in *Haematococcus pluvialis* have been reported (see Kathiresan et al., *Journal of Phycology*, Vol. 45 (2009), pp 642-649).

In an embodiment of the present invention, vector pPlat-pds-L504R, comprising the nucleotide sequence encoding the Pds-L504R gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Haematococcus pluvialis* to reflect the codon bias inherent in nuclear genes of *Haematococcus pluvialis* in accordance with Tables 24 A-D. For each lipid biosynthesis pathway protein of Table 25, the codon-optimized gene sequence can individually be operably linked to the *Haematococcus pluvialis* pds gene promoter upstream of the protein-coding sequence and operably linked to the *Haematococcus pluvialis* pds gene 3'UTR/terminator at the 3' region, or downstream, of the protein-coding sequence. The transformation construct may additionally comprise homology regions to the *Haematococcus pluvialis* genome for targeted genomic integration of the transformation vector. Homology regions may be selected to disrupt one or more genomic sites of endogenous lipid biosynthesis pathway genes. Stable transformation of *Haematococcus pluvialis* with the transformation vector is achieved through well-known transformation techniques including microprojectile bombardment or other known methods. Activity of the Pds-L504R gene product may be used as a marker to select for *Haematococcus pluvialis* transformed with the transformation vector on, but not limited to, OHA medium comprising norflurazon. Growth media suitable for *Haematococcus pluvialis* lipid production include, but are not limited to basal medium and those culture media described by Kobayashi et al., Kathiresan et al, and Gong and Chen, *Journal of Applied Phycology*, Vol. 9:5 (1997), pp. 437-444). Evaluation of fatty acid profiles of *Haematococcus pluvialis* lipids may be assessed through standard lipid extraction and analytical methods described herein.

Example 17

Engineering *Closterium Peracerosum-Strigosum-Littorale* Complex

Expression of recombinant genes in accordance with the present invention in *Closterium peracerosum-strigosum-littorale* complex may be accomplished by modifying the methods and vectors taught by Abe et al. as discussed herein. Briefly, Abe et al., *Plant Cell Physiology*, Vol. 52:9 (2011), pp. 1676-1685, reported the stable nuclear transformation of *Closterium peracerosum-strigosum-littorale* complex with plasmid DNA. Using the transformation methods of microprojectile bombardment, Abe introduced the plasmid pSA106 into *Closterium peracerosum-trigosum-littorale* complex. Plasmid pSA106 comprised a bleomycin resistance cassette, comprising sequence encoding the *Streptoalloteichus hindustanus* Bleomycin binding protein gene (ble, GenBank Accession No. CAA37050) operably linked to the promoter and 3' UTR of the *Closterium peracerosum-strigosum-littorale* complex Chlorophyll a/b-binding protein gene (CAB, GenBank Accession No. AB363403). Prior to transformation with pSA106, *Closterium peracerosum-strigosum-littorale* complex was unable to propagate on medium comprising 3 ug/ml phleomycin. Upon transformation with pSA106, transformants of *Closterium peracerosum-strigosum-littorale* complex were obtained that were propagated in selective culture medium comprising 3 ug/ml phleomycin. The expression of the ble gene product in *Closterium peracerosum-strigosum-littorale* complex enabled propagation in the presence of 3 ug/ml phleomycin, thereby establishing the utility of the bleomycin antibiotic resistance cassette as selectable marker for use in *Closterium peracerosum-strigosum-littorale* complex. Evaluation of the genomic DNA of the stable transformants was performed by Southern analysis. As reported by Abe, selection and maintenance of transformed *Closterium peracerosum-strigosum-littorale* complex was conducted first in top agar with C medium (0.1 g/L KNO$_3$, 0.015 g/L Ca(NO$_3$)$_2$.4H2O, 0.05 g/L glycerophosphate-Na2, 0.04 g/L MgSO$_4$.7H$_2$O, 0.5 g/L Tris (hydroxylmethyl)aminomethane, trace minerals, biotin, vitamins B$_1$ and B$_{12}$) and then subsequently isolated to agar plates comprising C medium supplemented with phleomycin. As reported by Abe, propagation of *Closterium peracerosum-strigosum-littorale* complex in liquid culture was performed in C medium. Additional liquid culture medium suitable for propagation of *Closterium peracerosum-strigosum-littorale* complex are discussed by Sekimoto et al., *DNA Research*, 10:4 (2003), pp. 147-153. Abe reported that the pSA106 plasmid and promoter and 3' UTR of the *Closterium peracerosum-strigosum-littorale* complex CAB gene are suitable to enable heterologous gene expression in *Closterium peracerosum-strigosum-littorale* complex. In addition, Abe reported that the bleomycin resistance cassette encoded on pSA106 was suitable for use as a selectable marker in *Closterium peracerosum-strigosum-littorale* complex. Additional plasmids, promoters, 3'UTR/terminators, and selectable markers suitable for enabling heterologous gene expression in *Closterium peracerosum-strigosum-littorale* complex have been reported (see Abe et al., *Plant Cell Physiology*, Vol. 49 (2008), pp. 625-632).

In an embodiment of the present invention, vector pSA106, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Closterium peracerosum-strigosum-littorale* complex to reflect the codon bias inherent in nuclear genes of *Closterium peracerosum-strigosum-littorale* complex in accordance with Tables 24A-D. For each lipid biosynthesis pathway protein of Table 25, the codon-optimized gene sequence can individually be operably linked to the *Closterium peracerosum-strigosum-littorale* complex CAB gene promoter upstream of the protein-coding sequence and operably linked to the *Closterium peracerosum-strigosum-littorale* complex CAB gene 3'UTR/terminator at the 3' region, or downstream, of the protein-coding sequence. The transformation construct may additionally comprise homology regions to the *Closterium peracerosum-strigosum-littorale* complex genome for targeted genomic integration of the transformation vector. Homology regions may be selected to disrupt one or more genomic sites of endogenous lipid biosynthesis pathway genes. Stable transformation of *Closterium peracerosum-strigosum-littorale* complex with the transformation vector is achieved through well-known transformation techniques including microprojectile bombardment or other known methods. Activity of the ble gene product may be used as a marker to select for *Closterium peracerosum-strigosum-littorale* complex transformed with the transformation vector on, but not limited to, C medium comprising phleomycin. Growth media suitable for *Closterium peracerosum-strigosum-littorale* complex lipid production include, but are not limited to C medium and those culture media reported by Abe et al. and Sekimoto et al. Evaluation of fatty acid profiles of *Closterium peracerosum-strigosum-littorale* complex lipids may be assessed through standard lipid extraction and analytical methods described herein.

Example 18

Engineering *Dunaliella Viridis*

Expression of recombinant genes in accordance with the present invention in *Dunaliella viridis* may be accomplished by modifying the methods and vectors taught by Sun et al. as discussed herein. Briefly, Sun et al., *Gene*, Vol. 377 (2006), pp. 140-149, reported the stable transformation of *Dunaliella viridis* with plasmid DNA. Using the transformation method of electoporation, Sun introduced the plasmid pDVNR, encoding the full *Dunaliella viridis* nitrate reductase gene into mutant *Dunaliella viridis* (*Dunaliella viridis* NR-mutants.) The NR-mutants are incapable of growth without the use of nitrate as a source of nitrogen. Nitrate reductase catalyzes the conversion of nitrate to nitrite. Prior to transformation, *Dunaliella viridis* NR-mutants were unable to propagate in culture medium comprising nitrate (NO$_3^-$) as the sole nitrogen source. The expression of the *Dunaliella viridis* NR gene product in NR-mutant *Dunaliella viridis* was used as a selectable marker to rescue the nitrate metabolism deficiency. Upon transformation with the pDVNR plasmid, NR-mutant *Dunaliella viridis* stably expressing the *Dunaliella viridis* NR gene product were obtained that were able to grow on agar plates comprising nitrate as the sole carbon source. Evaluation of the DNA of the stable transformants was performed by Southern analysis. Selection and maintenance of the transformed *Dunaliella viridis* (NR mutant) was performed on agar plates comprising 5 mM KNO$_3$. Sun also reported the propagation of *Dunaliella viridis* and *Dunaliella viridis* NR mutants in liquid culture medium. Additional media suitable for propagation of *Dunaliella viridis* are reported by Gordillo et al., *Journal of Applied Phycology*, Vol. 10:2 (1998), pp. 135-144 and by Moulton and Burford, *Hydrobiologia*, Vols. 204-205:1 (1990), pp. 401-408. Sun reported that the plasmid pDVNR and the promoter and 3' UTR/terminator of the *Dunaliella viridis* nitrate reductase gene were suitable to enable heterologous expression in *Dunaliella viridis* NR-mutants. Sun also reported that expression of the *Dunaliella viridis* nitrate reductase gene product was suitable for use as a selectable marker in *Dunaliella viridis* NR-mutants.

In an embodiment of the present invention, vector pDVNR, comprising the nucleotide sequence encoding the *Dunaliella viridis* nitrate reductase (DvNR) gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Dunaliella viridis* to reflect the codon bias inherent in nuclear genes of *Dunaliella viridis* in accordance with Tables 24A-D. For each lipid biosynthesis pathway protein of Table 25, the codon-optimized gene sequence can individually be operably linked to the DvNR promoter upstream of the protein-coding sequence and operably linked to the DvNR 3'UTR/terminator at the 3' region, or downstream, of the protein-coding sequence. The transformation construct may additionally comprise homology regions to the *Dunaliella viridis* genome for targeted genomic integration of the transformation vector. Homology regions may be selected to disrupt one or more genomic sites of endogenous lipid biosynthesis pathway genes. Stable transformation of *Dunaliella viridis* NR mutants with the transformation vector is achieved through well-known transformation techniques including electorporation or other known methods. Activity of the DvNR gene product may be used as a selectable marker to rescue the nitrogen assimiliation deficiency of *Dunaliella viridis* NR mutant strains and to select for *Dunaliella viridis* NR-mutants stably expressing the transformation vector. Growth media suitable for *Dunaliella viridis* lipid production include, but are not limited to those discussed by Sun et al., Moulton and Burford, and Gordillo et al. Evaluation of fatty acid profiles of *Dunaliella viridis* lipids may be assessed through standard lipid extraction and analytical methods described herein.

Example 19

Engineering *Dunaliella Salina*

Expression of recombinant genes in accordance with the present invention in *Dunaliella salina* may be accomplished by modifying the methods and vectors taught by Geng et al. as discussed herein. Briefly, Geng et al., *Journal of Applied Phycology*, Vol. 15 (2003), pp. 451-456, reported the stable transformation of *Dunaliella salina* with plasmid DNA. Using the transformation method of electroporation, Geng introduced the pUΩHBsAg-CAT plasmid into *Dunaliella salina*. pUΩHBsAg-CAT comprises a hepatitis B surface antigen (HBsAG) expression cassette comprising sequence encoding the hepatitis B surface antigen operably linked to a *Zea mays* ubi1 promoter upstream of the HBsAG protein-coding region and operably linked to the 3'UTR/terminator of the *Agrobacterium tumefaciens* nopaline synthase gene (nos) downstream of the HBsAG protein-coding region. pUΩHBsAg-CAT further comprised a chloramphenicol resistance cassette, comprising sequence encoding the chloramphenicol acetyltransferase (CAT) gene product, conferring resistance to the antibiotic chloramphenicol, operably linked to the simian virus 40 promoter and enhancer. Prior to transformation with pUΩHBsAg-CAT, *Dunaliella salina* was unable to propagate on medium comprising 60 mg/L chloramphenicol. Upon transformation with the pUΩHBsAg-CAT plasmid, transformants of *Dunaliella salina* were obtained that were propagated in selective culture medium comprising 60 mg/L chloramphenicol. The expression of the CAT gene product in *Dunaliella salina* enabled propagation in the presence of 60 mg/L chloramphenicol, thereby establishing the utility of the chloramphenicol resistance cassette as selectable marker for use in *Dunaliella salina*. Detectable activity of the HBsAg gene product indicated that ubi1 promoter and nos 3'UTR/terminator are suitable for enabling gene expression in *Dunaliella salina*. Evaluation of the genomic DNA of the stable transformants was performed by Southern analysis. Geng reported that selection and maintenance of the transformed *Dunaliella salina* was performed on agar plates comprising Johnson's medium (J1, described by Borowitzka and Borowitzka (eds), Micro-algal Biotechnology. Cambridge University Press, Cambridge, pp. 460-461) with 60 mg/L chloramphenicol. Liquid propagation of *Dunaliella salina* was performed by Geng in J1 medium with 60 mg/L chloramphenicol. Propagation of *Dunaliella salina* in media other than J1 medium has been discussed (see Feng et al., *Mol. Bio. Reports*, Vol. 36 (2009), pp. 1433-1439 and Borowitzka et al., *Hydrobiologia*, Vols. 116-117:1 (1984), pp. 115-121). Additional plasmids, promoters, 3'UTR/terminators, and selectable markers suitable for enabling heterologous gene expression in *Dunaliella salina* have been reported by Feng et al. Geng reported that the plasmid pUΩHBsAg-CAT, the ubi1 promoter, and the *Agrobacterium tumefaciens* nopaline synthase gene 3'UTR/terminator are suitable to enable exogenous gene expression in *Dunaliella salina*. In addition, Geng reporteds that the CAT resistance cassette encoded on pUΩ-HBsAg-CAT was suitable for use as a selectable marker in *Dunaliella salina*.

In an embodiment of the present invention, vector pUΩH-BsAg-CAT, comprising the nucleotide sequence encoding the CAT gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Dunaliella salina* to reflect the codon bias inherent in nuclear genes of *Dunaliella salina* in accordance with Tables 24A-D. For each lipid biosynthesis pathway protein of Table 25, the codon-optimized gene sequence can individually be operably linked to the ubi1 promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Dunaliella salina* genome for targeted genomic integration of the transformation vector. Homology regions may be selected to disrupt one or more genomic sites of endogenous lipid biosynthesis pathway genes. Stable transformation of *Dunaliella salina* with the transformation vector is achieved through well-known transformation techniques including electroporation or other known methods. Activity of the CAT gene product may be used as a selectable marker to select for *Dunaliella salina* transformed with the transformation vector in, but not limited to, J1 medium comprising chrloramphenicol. Growth medium suitable for *Dunaliella salina* lipid production include, but are not limited to J1 medium and those culture media described by Feng et al. and Borowitzka et al. Evaluation of fatty acid profiles of *Dunaliella salina* lipids may be assessed through standard lipid extraction and analytical methods described herein.

Example 20

Engineering *Gonium Pectoral*

Expression of recombinant genes in accordance with the present invention in *Gonium pectoral* may be accomplished by modifying the methods and vectors taught by Lerche and Hallman et al. as discussed herein. Briefly, Lerche and Hallman et al., *BMC Biotechnology*, Volume 9:64, 2009, reported the stable nuclear transformation of *Gonium pectorale* with plasmid DNA. Using the transformation method of microprojectile bombardment, Lerche introduced the plasmid pPmr3 into *Gonium pectorale*. Plasmid pPmr3 comprised a paromomycin resistance cassette, comprising a sequence encoding the aminoglycoside 3'-phosphotransferase (aphVIII) gene product (GenBank Accession No. AAB03856) of *Streptomyces rimosus* for resistance to the antibiotic paromomycin, operably linked to the *Volvox carteri* hsp70A-rbcS3 hybrid promoter upstream of the aphVIII protein-coding region and operably linked to the 3' UTR/terminator of the *Volvox carteri* rbcS3 gene downstream of the aphVIII protein-coding region. Prior to transformation with pPmr3, *Gonium pectorale* was unable to propagate on medium comprising 0.06 ug/ml paromomycin. Upon transformation with pPmr3, transformants of *Gonium pectorale* were obtained that were propagated in selective culture medium comprising 0.75 and greater ug/ml paromomycin. The expression of the aphVIII gene product in *Gonium pectorale* enabled propagation in the presence of 0.75 and greater ug/ml paromomycin, thereby establishing the utility of the paromomycin antibiotic resistance cassette as selectable marker for use in *Gonium pectorale*. Evaluation of the genomic DNA of the stable transformants was performed by Southern analysis. Lerche and Hallman reported that selection and maintenance of the transformed *Gonium pectorale* was performed in liquid Jaworski's medium (20 mg/L Ca(NO$_3$)$_2$.4H$_2$O, 12.4 mg/L KH$_2$PO$_4$, 50 mg/L MgSO$_4$.7H$_2$O, 15.9 mg/L NaHCO$_3$, 2.25 mg/L EDTA-FeNa, 2.25 mg/L EDTA Na$_2$, 2.48 g/L H$_3$BO$_3$, 1.39 g/L MnCl$_2$.4H$_2$O, 1 mg/L (NH$_4$)$_6$MO$_7$O$_2$4.4H$_2$O, 0.04 mg/L vitamin B12, 0.04 mg/L Thiamine-HCl, 0.04 mg/L biotin, 80 mg/L NaNO$_3$, 36 mg/L Na$_4$HPO$_4$.12H$_2$O) with 1.0 ug/ml paromomycin. Additional plasmids, promoters, 3'UTR/terminators, and selectable markers suitable for enabling heterologous gene expression in *Gonium pectorale* are further discussed by Lerche and Hallman. Lerche and Hallman reported that the plasmid pPmr3, *Volvox carteri* hsp70A-rbcS3 hybrid promoter, and the 3' UTR/terminator of the *Volvox carteri* rbcS3 gene are suitable to enable exogenous gene expression in *Gonium pectorale*. In addition, Lerche and Hallman reported that the paromomycin resistance cassette encoded pPmr3 was suitable for use as a selectable marker in *Gonium pectorale*.

In an embodiment of the present invention, vector pPmr3, comprising the nucleotide sequence encoding the aphVIII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Gonium pectorale* to reflect the codon bias inherent in nuclear genes of *Gonium pectorale* in accordance with Tables 24A-D. For each lipid biosynthesis pathway protein of Table 25, the codon-optimized gene sequence can individually be operably linked to the *Volvox carteri* hsp70A-rbcS3 hybrid promoter upstream of the protein-coding sequence and operably linked to the *Volvox carteri* rbcS3 gene 3'UTR/terminator at the 3' region, or downstream, of the protein-coding sequence. The transformation construct may additionally comprise homology regions to the *Gonium pectorale* genome for targeted genomic integration of the transformation vector. Homology regions may be selected to disrupt one or more genomic sites of endogenous lipid biosynthesis pathway genes. Stable transformation of *Gonium pectorale* with the transformation vector may be achieved through well-known transformation techniques including microprojectile bombardment or other known methods. Activity of the aphVIII gene product may be used as a selectable marker to select for *Gonium pectorale* transformed with the transformation vector in, but not limited to, Jaworski's medium comprising paromomycin. Growth media suitable for *Gonium pectorale* lipid production include Jawaorski's medium and media reported by Stein, American Journal of Botany, Vol. 45:9 (1958), pp. 664-672. Evaluation of fatty acid profiles of *Gonium pectorale* lipids may be assessed through standard lipid extraction and analytical methods described herein.

Example 21

Engineering *Phaeodactylum Tricornutum*

Expression of recombinant genes in accordance with the present invention in *Phaeodactylum tricornutum* may be accomplished by modifying the methods and vectors taught by Apt et al. as discussed herein. Briefly, Apt et al., *Molecular and General Genetics*, Vol. 252 (1996), pp. 572-579, reported the stable nuclear transformation of *Phaeodactylum tricornutum* with vector DNA. Using the transformation technique of microprojectile bombardment, Apt introduced the plasmid pfcpA into *Phaeodactylum tricornutum*. Plasmid pfcpA comprised a bleomycin resistance cassette, comprising sequence encoding the *Streptoalloteichus hindustanus* Bleomycin binding protein (ble), for resistance to the antibiotics phleomycin and zeocin, operably linked to the promoter of the *Phaeodactylum tricornutum* fucoxanthin chlorophyll a binding protein gene (fcpA) upstream of the ble protein-coding region and operably linked to the 3' UTR/terminator of the *Phaeodactylum tricornutum* fcpA gene at the 3' region, or downstream of the ble protein-coding region. Prior to transformation with pfcpA, *Phaeodactylum tricornutum* was unable to propagate on medium comprising 50 ug/ml zeocin. Upon transformation with pfcpA, transformants of *Phaeodactylum tricornutum* were obtained that were propagated in selective culture medium comprising 50 ug/ml zeocin. The expression of the ble gene product in *Phaeodactylum tricornutum* enabled propagation in the presence of 50 ug/ml zeocin, thereby establishing the utility of the bleomycin antibiotic resistance cassette as selectable marker for use in *Phaeodactylum tricornutum*. Evaluation of the genomic DNA of the stable transformants was performed by Southern analysis. Apt reported that selection and maintenance of the transformed *Phaeodactylum tricornutum* was performed on agar plates comprising LDM medium (as reported by Starr and Zeikus, *Journal of Phycology*, Vol. 29, Supplement, (1993)) with 50 mg/L zeocin. Apt reported liquid propagation of *Phaeodactylum tricornutum* transformants in LDM medium with 50 mg/L zeocin. Propagation of *Phaeodactylum tricornutum* in medium other than LDM medium has been discussed (by Zaslayskaia et al., *Science*, Vol. 292 (2001), pp. 2073-2075, and by Radokovits et al., *Metabolic Engineering*, Vol. 13 (2011), pp. 89-95). Additional plasmids, promoters, 3'UTR/terminators, and selectable markers suitable for enabling heterologous gene expression in *Phaeodactylum tricornutum* have been reported in the same report by Apt et al., by Zaslavskaia et al., and by Radokovits et al.). Apt reported that the plasmid pfcpA, and the *Phaeodactylum tricornutum* fcpA promoter and 3' UTR/terminator are suitable to enable exogenous gene expression in *Phaeodactylum tricornutum*. In addition, Apt reported that the bleomycin resistance cassette encoded on pfcpA was suitable for use as a selectable marker in *Phaeodactylum tricornutum*.

In an embodiment of the present invention, vector pfcpA, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Phaeodactylum tricornutum* to reflect the codon bias inherent in nuclear genes of *Phaeodactylum tricornutum* in accordance with Tables 24A-D. For each lipid biosynthesis pathway protein of Table 25, the codon-optimized gene sequence can individually be operably linked to the *Phaeodactylum tricornutum* fcpA gene promoter upstream of the protein-coding sequence and operably linked to the *Phaeodactylum tricornutum* fcpA gene 3'UTR/terminator at the 3' region, or downstream, of the protein-coding sequence. The transformation construct may additionally comprise homology regions to the *Phaeodactylum tricornutum* genome for targeted genomic integration of the transformation vector. Homology regions may be selected to disrupt one or more genomic sites of endogenous lipid biosynthesis pathway genes. One skilled in the art can identify such homology regions within the sequence of the *Phaeodactylum tricornutum* genome (referenced in the publication by Bowler et al., *Nature*, Vol. 456 (2008), pp. 239-244). Stable transformation of *Phaeodactylum tricornutum* with the transformation vector is achieved through well-known transformation techniques including microprojectile bombardment or other known methods. Activity of the ble gene product may be used as a marker to select for *Phaeodactylum tricornutum* transformed with the transformation vector in, but not limited to, LDM medium comprising paromomycin. Growth medium suitable for *Phaeodactylum tricornutum* lipid production include, but are not limited to f/2 medium as reported by Radokovits et al. Evaluation of fatty acid profiles of *Phaeodactylum tricornutum* lipids may be assessed through standard lipid extraction and analytical methods described herein.

Example 22

Engineering *Chaetoceros* Sp.

Expression of recombinant genes in accordance with the present invention in *Chaetoceros* sp. may be accomplished by modifying the methods and vectors taught by Yamaguchi et al. as discussed herein. Briefly, Yamaguchi et al., *Phycological Research*, Vol. 59:2 (2011), pp. 113-119, reported the stable nuclear transformation of *Chaetoceros* sp. with plasmid DNA. Using the transformation method of microprojectile bombardment, Yamaguchi introduced the plasmid pTpfcp/nat into *Chaetoceros* sp. pTpfcp/nat comprised a nourseothricin resistance cassette, comprising sequence encoding the nourseothricin acetyltransferase (nat) gene product (GenBank Accession No. AAC60439) operably linked to the *Thalassiosira pseudonana* fucoxanthin chlorophyll a/c binding protein gene (fcp) promoter upstream of the nat protein-coding region and operably linked to the *Thalassiosira pseudonana* fcp gene 3' UTR/terminator at the 3' region (downstream of the nat protein coding-sequence). The nat gene product confers resistance to the antibiotic nourseothricin. Prior to transformation with pTpfcp/nat, *Chaetoceros* sp. was unable to propagate on medium comprising 500 ug/ml nourseothricin. Upon transformation with pTpfcp/nat, transformants of *Chaetoceros* sp. were obtained that were propagated in selective culture medium comprising 500 ug/ml nourseothricin. The expression of the nat gene product in *Chaetoceros* sp. enabled propagation in the presence of 500 ug/ml nourseothricin, thereby establishing the utility of the nourseothricin antibiotic resistance cassette as selectable marker for use in *Chaetoceros* sp. Evaluation of the genomic DNA of the stable transformants was performed by Southern analysis. Yamaguchi reported that selection and maintenance of the transformed *Chaetoceros* sp. was performed on agar plates comprising f/2 medium (as reported by Guilard, R. R., Culture of Phytoplankton for feeding marine invertebrates, In Culture of Marine Invertebrate Animals, Smith and Chanley (eds) 1975, Plenum Press, New York, pp. 26-60) with 500 ug/ml nourseothricin. Liquid propagation of *Chaetoceros* sp. transformants, as performed by Yamaguchi, was carried out in f/2 medium with 500 mg/L nourseothricin. Propagation of *Chaetoceros* sp. in additional culture medium has been reported (for example in Napolitano et al., *Journal of the World Aquaculture Society*, Vol. 21:2 (1990), pp. 122-130, and by Volkman et al., *Journal of Experimental Marine Biology and Ecology*, Vol. 128:3 (1989), pp. 219-240). Additional plasmids, promoters, 3'UTR/terminators, and selectable markers suitable for enabling heterologous gene expression in *Chaetoceros* sp. have been reported in the same report by Yamaguchi et al. Yamaguchi reported that the plasmid pTpfcp/nat, and the *Thalassiosira pseudonana* fcp promoter and 3' UTR/terminator are suitable to enable exogenous gene expression in *Chaetoceros* sp. In addition, Yamaguchi reported that the nourseothricin resistance cassette encoded on pTpfcp/nat was suitable for use as a selectable marker in *Chaetoceros* sp.

In an embodiment of the present invention, vector pTpfcp/nat, comprising the nucleotide sequence encoding the nat gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in the closely-related *Chaetoceros compressum* to reflect the codon bias inherent in nuclear genes of *Chaetoceros compressum* in accordance with Tables 24A-D. For each lipid biosynthesis pathway protein of Table 25, the codon-optimized gene sequence can individually be operably linked to the *Thalassiosira pseudonana* fcp gene promoter upstream of the protein-coding sequence and operably linked to the *Thalassiosira pseudonana* fcp gene 3'UTR/terminator at the 3' region, or downstream, of the protein-coding sequence. The transformation construct may additionally comprise homology regions to the *Chaetoceros* sp. genome for targeted genomic integration of the transformation vector. Homology regions may be selected to disrupt one or more genomic sites of endogenous lipid biosynthesis pathway genes. Stable transformation of *Chaetoceros* sp. with the transformation vector is achieved through well-known transformation including microprojectile bombardment or other known methods. Activity of the nat gene product may be used as a selectable marker to select for *Chaetoceros* sp. transformed with the transformation vector in, but not limited to, f/2 agar medium comprising nourseothricin. Growth medium suitable for *Chaetoceros* sp. lipid production include, but are not limited to, f/2 medium, and those culture media discussed by Napolitano et al. and Volkman et al. Evaluation of fatty acid profiles of *Chaetoceros* sp lipids may be assessed through standard lipid extraction and analytical methods described herein.

Example 23

Engineering *Cylindrotheca Fusiformis*

Expression of recombinant genes in accordance with the present invention in *Cylindrotheca fusiformis* may be accomplished by modifying the methods and vectors taught by Poulsen and Kroger et al. as discussed herein. Briefly, Poulsen and Kroger et al., *FEBS Journal*, Vol. 272 (2005), pp. 3413-3423, reported the transformation of *Cylindrotheca fusiformis* with plasmid DNA. Using the transformation method of microprojectile bombardment, Poulsen and Kroger introduced the pCF-ble plasmid into *Cylindrotheca fusiformis*. Plasmid pCF-ble comprised a bleomycin resistance cassette, comprising sequence encoding the *Streptoalloteichus hindustanus* Bleomycin binding protein (ble), for resistance to the antibiotics zeocin and phleomycin, operably linked to the *Cylindrotheca fusiformis* fucozanthin chlorophyll a/c binding protein gene (fcpA, GenBank Accesssion No. AY125580) promoter upstream of the ble protein-coding region and operably linked to the *Cylindrotheca fusiformis* fcpA gene 3'UTR/terminator at the 3' region (down-stream of the ble protein-coding region). Prior to transformation with pCF-ble, *Cylindrotheca fusiformis* was unable to propagate on medium comprising 1 mg/ml zeocin. Upon transformation with pCF-ble, transformants of *Cylindrotheca fusiformis* were obtained that were propagated in selective culture medium comprising 1 mg/ml zeocin. The expression of the ble gene product in *Cylindrotheca fusiformis* enabled propagation in the presence of 1 mg/ml zeocin, thereby establishing the utility of the bleomycin antibiotic resistance cassette as selectable marker for use in *Cylindrotheca fusiformis*. Poulsen and Kroger reported that selection and maintenance of the transformed *Cylindrotheca fusiformis* was performed on agar plates comprising artificial seawater medium with 1 mg/ml zeocin. Poulsen and Kroger reported liquid propagation of *Cylindrotheca fusiformis* transformants in artificial seawater medium with 1 mg/ml zeocin. Propagation of *Cylindrotheca fusiformis* in additional culture medium has been discussed (for example in Liang et al., *Journal of Applied Phycology*, Vol. 17:1 (2005), pp. 61-65, and by Orcutt and Patterson, *Lipids*, Vol. 9:12 (1974), pp. 1000-1003). Additional plasmids, promoters, and 3'UTR/terminators for enabling heterologous gene expression in *Chaetoceros* sp. have been reported in the same report by Poulsen and Kroger. Poulsen and Kroger reported that the plasmid pCF-ble and the *Cylindrotheca fusiformis* fcp promoter and 3' UTR/terminator are suitable to enable exogenous gene expression in *Cylindrotheca fusiformis*. In addition, Poulsen and Kroger reported that the bleomycin resistance cassette encoded on pCF-ble was suitable for use as a selectable marker in *Cylindrotheca fusiformis*.

In an embodiment of the present invention, vector pCF-ble, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Cylindrotheca fusiformis* to reflect the codon bias inherent in nuclear genes of *Cylindrotheca fusiformis* in accordance with Tables 24A-D. For each lipid biosynthesis pathway protein of Table 25, the codon-optimized gene sequence can individually be operably linked to the *Cylindrotheca fusiformis* fcp gene promoter upstream of the protein-coding sequence and operably linked to the *Cylindrotheca fusiformis* fcp gene 3'UTR/terminator at the 3' region, or downstream, of the protein-coding sequence. The transformation construct may additionally comprise homology regions to the *Cylindrotheca fusiformis* genome for targeted genomic integration of the transformation vector. Homology regions may be selected to disrupt one or more genomic sites of endogenous lipid biosynthesis pathway genes. Stable transformation of *Cylindrotheca fusiformis* with the transformation vector is achieved through well-known transformation techniques including microprojectile bombardment or other known methods. Activity of the ble gene product may be used as a selectable marker to select for *Cylindrotheca fusiformis* transformed with the transformation vector in, but not limited to, artificial seawater agar medium comprising zeocin. Growth media suitable for *Cylindrotheca fusiformis* lipid production include, but are not limited to, artificial seawater and those media reported by Liang et al. and Orcutt and Patterson. Evaluation of fatty acid profiles of *Cylindrotheca fusiformis* lipids may be assessed through standard lipid extraction and analytical methods described herein.

Example 24

Engineering *Amphidinium* Sp.

Expression of recombinant genes in accordance with the present invention in *Amphidinium* sp. may be accomplished by modifying the methods and vectors taught by ten Lohuis and Miller et al. as discussed herein. Briefly, ten Lohuis and Miller et al., *The Plant Journal*, Vol. 13:3 (1998), pp. 427-435, reported the stable transformation of *Amphidinium* sp. with plasmid DNA. Using the transformation technique of agitation in the presence of silicon carbide whiskers, ten Lohuis introduced the plasmid pMT NPT/GUS into *Amphidinium* sp. pMT NPT/GUS comprised a neomycin resistance cassette, comprising sequence encoding the neomycin phosphotransferase II (nptII) gene product (GenBank Accession No. AAL92039) operably linked to the *Agrobacterium tumefaciens* nopaline synthase (nos) gene promoter upstream, or 5' of the nptII protein-coding region and operably linked to the 3' UTR/terminator of the nos gene at the 3' region (downstream of the nptII protein-coding region). The nptII gene product confers resistance to the antibiotic G418. The pMT NPT/GUS plasmid further comprised sequence encoding a beta-glucuronidase (GUS) reporter gene product operably-linked to a CaMV 35S promoter and further operably linked to the CaMV 35S 3' UTR/terminator. Prior to transformation with pMT NPT/GUS, *Amphidinium* sp. was unable to be propagated on medium comprising 3 mg/ml G418. Upon transformation with pMT NPT/GUS, transformants of *Amphidinium* sp. were obtained that were propagated in selective culture medium comprising 3 mg/ml G418. The expression of the nptII gene product in *Amphidinium* sp. enabled propagation in the presence of 3 mg/ml G418, thereby establishing the utility of the neomycin antibiotic resistance cassette as selectable marker for use in *Amphidinium* sp. Detectable activity of the GUS reporter gene indicated that CaMV 35S promoter and 3'UTR are suitable for enabling gene expression in *Amphidinium* sp. Evaluation of the genomic DNA of the stable transformants was performed by Southern analysis. ten Lohuis and Miller reported liquid propagation of *Amphidinium* sp transformants in medium comprising seawater supplemented with F/2 enrichment solution (provided by the supplier Sigma) and 3 mg/ml G418 as well as selection and maintenance of *Amphidinium* sp. transformants on agar medium comprising seawater supplemented with F/2 enrichment solution and 3 mg/ml G418. Propagation of *Amphidinium* sp. in additional culture medium has been reported (for example in Mansour et al., *Journal of Applied Phycology*, Vol. 17:4 (2005) pp. 287-v300). An additional plasmid, comprising additional promoters, 3'UTR/terminators, and a selectable marker for enabling heterologous gene expression in *Amphidinium* sp. have been reported in the same report by ten Lohuis and Miller. ten Lohuis and Miller reported that the plasmid pMT NPT/GUS and the promoter and 3' UTR/terminator of the nos and CaMV 35S genes are suitable to enable exogenous gene expression in *Amphidinium* sp. In addition, ten Lohuis and Miller reported that the neomycin resistance cassette encoded on pMT NPT/GUS was suitable for use as a selectable marker in *Amphidinium* sp.

In an embodiment of the present invention, vector pMT NPT/GUS, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Amphidinium* sp. to reflect the codon bias inherent in nuclear genes of the closely-related species, *Amphidinium carterae* in accordance with Tables 24A-D. For each lipid biosynthesis pathway protein of Table 25, the codon-optimized gene sequence can individually be operably linked to the *Agrobacterium tumefaciens* nopaline synthase (nos) gene promoter upstream of the protein-coding sequence and operably linked to the nos 3'UTR/terminator at the 3' region, or downstream, of the protein-coding sequence. The transformation construct may additionally comprise homology regions to the *Amphidinium* sp. genome for targeted genomic integration of the transformation vector. Homology regions may be selected to disrupt one or more genomic sites of endogenous lipid biosynthesis pathway genes. Stable transformation of *Amphidinium* sp. with the transformation vector is achieved through well-known transformation techniques including silicon fibre-mediated microinjection or other known methods. Activity of the nptII gene product may be used as a selectable marker to select for *Amphidinium* sp. transformed with the transformation vector in, but not limited to, seawater agar medium comprising G418. Growth media suitable for *Amphidinium* sp. lipid production include, but are not limited to, artificial seawater and those media reported by Mansour et al. and ten Lohuis and Miller. Evaluation of fatty acid profiles of *Amphidinium* sp. lipids may be assessed through standard lipid extraction and analytical methods described herein.

Example 25

Engineering *Symbiodinium Microadriacticum*

Expression of recombinant genes in accordance with the present invention in *Symbiodinium microadriacticum* may be accomplished by modifying the methods and vectors taught by ten Lohuis and Miller et al. as discussed herein. Briefly, ten Lohuis and Miller et al., *The Plant Journal*, Vol. 13:3 (1998), pp. 427-435, reported the stable transformation of *Symbiodinium microadriacticum* with plasmid DNA. Using the transformation technique of silicon fibre-mediated microinjection, ten Lohuis introduced the plasmid pMT NPT/GUS into *Symbiodinium microadriacticum*. pMT NPT/GUS comprised a neomycin resistance cassette, comprising sequence encoding the neomycin phosphotransferase II (nptII) gene product (GenBank Accession No. AAL92039) operably linked to the *Agrobacterium tumefaciens* nopaline synthase (nos) gene promoter upstream, or 5' of the nptII protein-coding region and operably linked to the 3' UTR/terminator of the nos gene at the 3' region (down-stream of the nptII protein-coding region). The nptII gene product confers resistance to the antibiotic G418. The pMT NPT/GUS plasmid further comprised sequence encoding a beta-glucuronidase (GUS) reporter gene product operably-linked to a CaMV 35S promoter and further operably linked to the CaMV 35S 3' UTR/terminator. Prior to transformation with pMT NPT/GUS, *Symbiodinium microadriacticum* was unable to be propagated on medium comprising 3 mg/ml G418. Upon transformation with pMT NPT/GUS, transformants of *Symbiodinium microadriacticum* were obtained that were propagated in selective culture medium comprising 3 mg/ml G418. The expression of the nptII gene product in *Symbiodinium microadriacticum* enabled propagation in the presence of 3 mg/ml G418, thereby establishing the utility of the neomycin antibiotic resistance cassette as selectable marker for use in *Symbiodinium microadriacticum*. Detectable activity of the GUS reporter gene indicated that CaMV 35S promoter and 3'UTR are suitable for enabling gene expression in *Symbiodinium microadriacticum*. Evaluation of the genomic DNA of the stable transformants was performed by Southern analysis. ten Lohuis and Miller reported liquid propagation of *Symbiodinium microadriacticum* transformants in medium comprising seawater supplemented with F/2 enrichment solution (provided by the supplier Sigma) and 3 mg/ml G418 as well as selection and maintenance of *Symbiodinium microadriacticum* transformants on agar medium comprising seawater supplemented with F/2 enrichment solution and 3 mg/ml G418. Propagation of *Symbiodinium microadriacticum* in additional culture medium has been discussed (for example in Iglesias-Prieto et al., *Proceedings of the National Academy of Sciences*, Vol. 89:21 (1992) pp. 10302-10305). An additional plasmid, comprising additional promoters, 3'UTR/terminators, and a selectable marker for enabling heterologous gene expression in *Symbiodinium microadriacticum* have been discussed in the same report by ten Lohuis and Miller. ten Lohuis and Miller reported that the plasmid pMT NPT/GUS and the promoter and 3' UTR/terminator of the nos and CaMV 35S genes are suitable to enable exogenous gene expression in *Symbiodinium microadriacticum*. In addition, ten Lohuis and Miller reported that the neomycin resistance cassette encoded on pMT NPT/GUS was suitable for use as a selectable marker in *Symbiodinium microadriacticum*.

In an embodiment of the present invention, vector pMT NPT/GUS, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected Table 25, each protein-coding sequence codon-optimized for expression in *Symbiodinium microadriacticum* to reflect the codon bias inherent in nuclear genes of *Symbiodinium microadriacticum* in accordance with Tables 24A-D. For each lipid biosynthesis pathway protein of Table 25, the codon-optimized gene sequence can individually be operably linked to the *Agrobacterium tumefaciens* nopaline synthase (nos) gene promoter upstream of the protein-coding sequence and operably linked to the nos 3'UTR/terminator at the 3' region, or downstream, of the protein-coding sequence. The transformation construct may additionally comprise homology regions to the *Symbiodinium microadriacticum* genome for targeted genomic integration of the transformation vector. Homology regions may be selected to disrupt one or more genomic sites of endogenous lipid biosynthesis pathway genes. Stable transformation of *Symbiodinium microadriacticum* with the transformation vector is achieved through well-known transformation techniques including silicon fibre-mediated microinjection or other known methods. Activity of the nptII gene product may be used as a selectable marker to select for *Symbiodinium microadriacticum* transformed with the transformation vector in, but not limited to, seawater agar medium comprising G418. Growth media suitable for *Symbiodinium microadriacticum* lipid production include, but are not limited to, artificial seawater and those media reported by Iglesias-Prieto et al. and ten Lohuis and Miller. Evaluation of fatty acid profiles of *Symbiodinium microadriacticum* lipids may be assessed through standard lipid extraction and analytical methods described herein.

Example 26

Engineering *Nannochloropsis* Sp.

Expression of recombinant genes in accordance with the present invention in *Nannochloropsis* sp. W2J3B may be accomplished by modifying the methods and vectors taught by Kilian et al. as discussed herein. Briefly, Kilian et al., *Proceedings of the National Academy of Sciences*, Vol. 108: 52 (2011) pp. 21265-21269, reported the stable nuclear transformation of *Nannochloropsis* with a transformation construct. Using the transformation method of electroporation, Kilian introduced the transformation construct C2 into *Nannochloropsis* sp. W2J3B. The C2 transformation construct comprised a bleomycin resistance cassette, comprising the coding sequence for the *Streptoalloteichus hindustanus* Bleomycin binding protein (ble), for resistance to the antibiotics phleomycin and zeocin, operably linked to and the promoter of the *Nannochloropsis* sp. W2J3B violaxanthin/chlorophyll a-binding protein gene VCP2 upstream of the ble protein-coding region and operably linked to the 3'UTR/terminator of the *Nannochloropsis* sp. W2J3B violaxanthin/chlorophyll a-binding gene VCP1 downstream of the ble protein-coding region. Prior to transformation with C2, *Nannochloropsis* sp. W2J3B was unable to propagate on medium comprising 2 ug/ml zeocin. Upon transformation with C2, transformants of *Nannochloropsis* sp. W2J3B were obtained that were propagated in selective culture medium comprising 2 ug/ml zeocin. The expression of the ble gene product in *Nannochloropsis* sp. W2J3B enabled propagation in the presence of 2 ug/ml zeocin, thereby establishing the utility of the bleomycin antibiotic resistance cassette as selectable marker for use in *Nannochloropsis*. Evaluation of the genomic DNA of the stable transformants was performed by PCR. Kilian reported liquid propagation of *Nannochloropsis* sp. W2J3B transformants in F/2 medium (reported by Guilard and Ryther, *Canadian Journal of Microbiology*, Vol. 8 (1962), pp. 229-239) comprising fivefold levels of trace metals, vitamins, and phosphate solution, and further comprising 2 ug/ml zeocin. Kilian also reported selection and maintenance of *Nannochloropsis* sp. W2J3B transformants on agar F/2 medium comprising artificial seawater 2 mg/ml zeocin. Propagation of *Nannochloropsis* in additional culture medium has been discussed (for example in Chiu et al., *Bioresour Technol.*, Vol. 100:2 (2009), pp. 833-838 and Pal et al., *Applied Microbiology and Biotechnology*, Vol. 90:4 (2011), pp. 1429-1441.). Additional transformation constructs, comprising additional promoters and 3'UTR/terminators for enabling heterologous gene expression in *Nannochloropsis* sp. W2J3B and selectable markers for selection of transformants have been described in the same report by Kilian. Kilian reported that the transformation construct C2 and the promoter of the *Nannochloropsis* sp. W2J3B violaxanthin/chlorophyll a-binding protein gene VCP2 and 3' UTR/terminator of the *Nannochloropsis* sp. W2J3B violaxanthin/chlorophyll a-binding protein gene VCP1 are suitable to enable exogenous gene expression in *Nannochloropsis* sp. W2J3B. In addition, Kilian reported that the bleomycin resistance cassette encoded on C2 was suitable for use as a selectable marker in *Nannochloropsis* sp. W2J3B.

In an embodiment of the present invention, transformation construct C2, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Nannochloropsis* sp. W2J3B to reflect the codon bias inherent in nuclear genes of *Nannochloropsis* sp. in accordance with Tables 24A-D. For each lipid biosynthesis pathway protein of Table 25, the codon-optimized gene sequence can individually be operably linked to the *Nannochloropsis* sp. W2J3B VCP2 gene promoter upstream of the protein-coding sequence and operably linked to the *Nannochloropsis* sp. W2J3B VCP1 gene 3'UTR/terminator at the 3' region, or downstream, of the protein-coding sequence. The transformation construct may additionally comprise homology regions to the *Nannochloropsis* sp. W2J3B genome for targeted genomic integration of the transformation vector. Homology regions may be selected to disrupt one or more genomic sites of endogenous lipid biosynthesis pathway genes. Stable transformation of *Nannochloropsis* sp. W2J3B with the transformation vector is achieved through well-known transformation techniques including electroporation or other known methods. Activity of the ble gene product may be used as a selectable marker to select for *Nannochloropsis* sp. W2J3B transformed with the transformation vector in, but not limited to, F/2 medium comprising zeocin. Growth media suitable for *Nannochloropsis* sp. W2J3B lipid production include, but are not limited to, F/2 medium and those media reported by Chiu et al. and Pal et al. Evaluation of fatty acid profiles of *Nannochloropsis* sp. W2J3B lipids may be assessed through standard lipid extraction and analytical methods described herein.

Example 27

Engineering *Cyclotella Cryptica*

Expression of recombinant genes in accordance with the present invention in *Cyclotella cryptica* may be accomplished by modifying the methods and vectors taught by Dunahay et al. as discussed herein. Briefly, Dunahay et al., *Journal of Phycology*, Vol. 31 (1995), pp. 1004-1012, reported the stable transformation of *Cyclotella cryptica* with plasmid DNA. Using the transformation method of microprojectile bombardment, Dunahay introduced the plasmid pACCNPT5.1 into *Cyclotella cryptica*. Plasmid pACCNPT5.1 comprised a neomycin resistance cassette, comprising the coding sequence of the neomycin phosphotransferase II (nptII) gene product operably linked to the promoter of the *Cyclotella cryptica* acetyl-CoA carboxylase (ACCase) gene (GenBank Accession No. L20784) upstream of the nptII coding-region and operably linked to the 3'UTR/terminator of the *Cyclotella cryptica* ACCase gene at the 3' region (downstream of the nptII coding-region). The nptII gene product confers resistance to the antibiotic G418. Prior to transformation with pACCNPT5.1, *Cyclotella cryptica* was unable to propagate on 50% artificial seawater medium comprising 100 ug/ml G418. Upon transformation with pACCNPT5.1, transformants of *Cyclotella cryptica* were obtained that were propagated in selective 50% artificial seawater medium comprising 100 ug/ml G418. The expression of the nptII gene product in *Cyclotella cryptica* enabled propagation in the presence of 100 ug/ml G418, thereby establishing the utility of the neomycin antibiotic resistance cassette as selectable marker for use in *Cyclotella cryptica*. Evaluation of the genomic DNA of the stable transformants was performed by Southern analysis. Dunahay reported liquid propagation of *Cyclotella cryptica* in artificial seawater medium (ASW, as discussed by Brown, L., *Phycologia*, Vol. 21 (1982), pp. 408-410) supplemented with 1.07 mM sodium silicate and with 100 ug/ml G418. Dunahay also reported selection and maintenance of *Cyclotella cryptica* transformants on agar plates comprising ASW medium with 100 ug/ml G418. Propagation of *Cyclotella cryptica* in additional culture medium has been discussed (for example in Sriharan et al., *Applied Biochemistry and Biotechnology*, Vol. 28-29:1 (1991), pp. 317-326 and Pahl et al., *Journal of Bioscience and Bioengineering*, Vol. 109:3 (2010), pp. 235-239). Dunahay reported that the plasmid pACCNPT5.1 and the promoter of the *Cyclotella cryptica* acetyl-CoA carboxylase (ACCase) gene are suitable to enable exogenous gene expression in *Cyclotella cryptica*. In addition, Dunahay reported that the neomycin resistance cassette encoded on pACCNPT5.1 was suitable for use as a selectable marker in *Cyclotella cryptica*.

In an embodiment of the present invention, vector pAC-CNPT5.1, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Cyclotella cryptica* to reflect the codon bias inherent in nuclear genes of *Cyclotella cryptica* in accordance with Tables 24A-D. For each lipid biosynthesis pathway protein of Table 25, the codon-optimized gene sequence can individually be operably linked to the *Cyclotella cryptica* ACCase promoter upstream of the protein-coding sequence and operably linked to the *Cyclotella cryptica* ACCase 3'UTR/terminator at the 3' region, or downstream, of the protein-coding sequence. The transformation construct may additionally comprise homology regions to the *Cyclotella cryptica* genome for targeted genomic integration of the transformation vector. Homology regions may be selected to disrupt one or more genomic sites of endogenous lipid biosynthesis pathway genes. Stable transformation of *Cyclotella cryptica* with the transformation vector is achieved through well-known transformation techniques including microprojectile bombardment or other known methods. Activity of the nptII gene product may be used as a marker to select for *Cyclotella cryptica* transformed with the transformation vector in, but not limited to, agar ASW medium comprising G418. Growth media suitable for *Cyclotella cryptica* lipid production include, but are not limited to, ASW medium and those media reported by Sriharan et al., 1991 and Pahl et al. Evaluation of fatty acid profiles of *Cyclotella cryptica* lipids may be assessed through standard lipid extraction and analytical methods described herein.

Example 28

Engineering *Navicula Saprophila*

Expression of recombinant genes in accordance with the present invention in *Navicula saprophila* may be accomplished by modifying the methods and vectors taught by Dunahay et al. as discussed herein. Briefly, Dunahay et al., *Journal of Phycology*, Vol. 31 (1995), pp. 1004-1012, reported the stable transformation of *Navicula saprophila* with plasmid DNA. Using the transformation method of microprojectile bombardment, Dunahay introduced the plasmid pACCNPT5.1 into *Navicula saprophila*. Plasmid pAC-CNPT5.1 comprised a neomycin resistance cassette, comprising the coding sequence of the neomycin phosphotransferase II (nptII) gene product operably linked to the promoter of the *Cyclotella cryptica* acetyl-CoA carboxylase (ACCase) gene (GenBank Accession No. L20784) upstream of the nptII coding-region and operably linked to the 3'UTR/terminator of the *Cyclotella cryptica* ACCase gene at the 3' region (downstream of the nptII coding-region). The nptII gene product confers resistance to the antibiotic G418. Prior to transformation with pACCNPT5.1, *Navicula saprophila* was unable to propagate on artificial seawater medium comprising 100 ug/ml G418. Upon transformation with pACCNPT5.1, transformants of *Navicula saprophila* were obtained that were propagated in selective artificial seawater medium comprising 100 ug/ml G418. The expression of the nptII gene product in *Navicula saprophila* enabled propagation in the presence of G418, thereby establishing the utility of the neomycin antibiotic resistance cassette as selectable marker for use in *Navicula saprophila*. Evaluation of the genomic DNA of the stable transformants was performed by Southern analysis. Dunahay reported liquid propagation of *Navicula saprophila* in artificial seawater medium (ASW, as discussed by Brown, L., *Phycologia*, Vol. 21 (1982), pp. 408-410) supplemented with 1.07 mM sodium silicate and with 100 ug/ml G418. Dunahay also reported selection and maintenance of *Navicula saprophila* transformants on agar plates comprising ASW medium with 100 ug/ml G418.

Propagation of *Navicula saprophila* in additional culture medium has been discussed (for example in Tadros and Johansen, *Journal of Phycology*, Vol. 24:4 (1988), pp. 445-452 and Sriharan et al., *Applied Biochemistry and Biotechnology*, Vol. 20-21:1 (1989), pp. 281-291). Dunahay reported that the plasmid pACCNPT5.1 and the promoter of the *Cyclotella cryptica* acetyl-CoA carboxylase (ACCase) gene are suitable to enable exogenous gene expression in *Navicula saprophila*. In addition, Dunahay reported that the neomycin resistance cassette encoded on pACCNPT5.1 was suitable for use as a selectable marker in *Navicula saprophila*.

In an embodiment of the present invention, vector pACCNPT5.1, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Navicula saprophila* to reflect the codon bias inherent in nuclear genes of the closely-related *Navicula pelliculosa* in accordance with Tables 24A-D. For each lipid biosynthesis pathway protein of Table 25, the codon-optimized gene sequence can individually be operably linked to the *Cyclotella cryptica* ACCase gene promoter upstream of the protein-coding sequence and operably linked to the *Cyclotella cryptica* ACCase gene 3'UTR/terminator at the 3' region, or downstream, of the protein-coding sequence. The transformation construct may additionally comprise homology regions to the *Navicula saprophila* genome for targeted genomic integration of the transformation vector. Homology regions may be selected to disrupt one or more genomic sites of endogenous lipid biosynthesis pathway genes. Stable transformation of *Navicula saprophila* with the transformation vector is achieved through well-known transformation techniques including microprojectile bombardment or other known methods. Activity of the nptII gene product may be used as a selectable marker to select for *Navicula saprophila* transformed with the transformation vector in, but not limited to, agar ASW medium comprising G418. Growth media suitable for *Navicula saprophila* lipid production include, but are not limited to, ASW medium and those media reported by Sriharan et al. 1989 and Tadros and Johansen. Evaluation of fatty acid profiles of *Navicula saprophila* lipids may be assessed through standard lipid extraction and analytical methods described herein.

Example 29

Engineering *Thalassiosira Pseudonana*

Expression of recombinant genes in accordance with the present invention in *Thalassiosira pseudonana* may be accomplished by modifying the methods and vectors taught by Poulsen et al. as discussed herein. Briefly, Poulsen et al., *Journal of Phycology*, Vol. 42 (2006), pp. 1059-1065, reported the stable transformation of *Thalassiosira pseudonana* with plasmid DNA. Using the transformation method of microprojectile bombardment, Poulsen introduced the plasmid pTpfcp/nat in to *Thalassiosira pseudonana*. pTpfcp/nat comprised a nourseothricin resistance cassette, comprising sequence encoding the nourseothricin acetyltransferase (nat) gene product (GenBank Accession No. AAC60439) operably linked to the *Thalassiosira pseudonana* fucoxanthin chlorophyll a/c binding protein gene (fcp) promoter upstream of the nat protein-coding region and operably linked to the *Thalassiosira pseudonana* fcp gene 3' UTR/terminator at the 3' region (downstream of the nat protein coding-sequence). The nat gene product confers resistance to the antibiotic nourseothricin. Prior to transformation with pTpfcp/nat, *Thalassiosira pseudonana* was unable to propagate on medium comprising 10 ug/ml nourseothricin. Upon transformation with pTpfcp/nat, transformants of *Thalassiosira pseudonana* were obtained that were propagated in selective culture medium comprising 100 ug/ml nourseothricin. The expression of the nat gene product in *Thalassiosira pseudonana* enabled propagation in the presence of 100 ug/ml nourseothricin, thereby establishing the utility of the nourseothricin antibiotic resistance cassette as selectable marker for use in *Thalassiosira pseudonana*. Evaluation of the genomic DNA of the stable transformants was performed by Southern analysis. Poulsen reported that selection and maintenance of the transformed *Thalassiosira pseudonana* was performed in liquid culture comprising modified ESAW medium (as discussed by Harrison et al., *Journal of Phycology*, Vol. 16 (1980), pp. 28-35) with 100 ug/ml nourseothricin. Propagation of *Thalassiosira pseudonana* in additional culture medium has been discussed (for example in Volkman et al., *Journal of Experimental Marine Biology and Ecology*, Vol. 128:3 (1989), pp. 219-240). An additional plasmid, comprising additional selectable markers suitable for use in *Thalassiosira pseudonana* has been discussed in the same report by Poulsen. Poulsen reported that the plasmid pTpfcp/nat, and the *Thalassiosira pseudonana* fcp promoter and 3' UTR/terminator are suitable to enable exogenous gene expression in *Thalassiosira pseudonana*. In addition, Poulsen reported that the nourseothricin resistance cassette encoded on pTpfcp/nat was suitable for use as a selectable marker in *Thalassiosira pseudonana*.

In an embodiment of the present invention, vector pTpfcp/nat, comprising the nucleotide sequence encoding the nat gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Thalassiosira pseudonana* to reflect the codon bias inherent in nuclear genes of *Thalassiosira pseudonana* in accordance with Tables 24A-D. For each lipid biosynthesis pathway protein of Table 25, the codon-optimized gene sequence can individually be operably linked to the *Thalassiosira pseudonana* fcp gene promoter upstream of the protein-coding sequence and operably linked to the *Thalassiosira pseudonana* fcp gene 3'UTR/terminator at the 3' region, or downstream, of the protein-coding sequence. The transformation construct may additionally comprise homology regions to the *Thalassiosira pseudonana* genome for targeted genomic integration of the transformation vector. Homology regions may be selected to disrupt one or more genomic sites of endogenous lipid biosynthesis pathway genes. One skilled in the art can identify such homology regions within the sequence of the *Thalassiosira pseudonana* genome (referenced in the publication by Armbrust et al., *Science*, Vol. 306: 5693 (2004): pp. 79-86). Stable transformation of *Thalassiosira pseudonana* with the transformation vector is achieved through well-known transformation techniques including microprojectile bombardment or other known methods. Activity of the nat gene product may be used as a marker to select for *Thalassiosira pseudonana* transformed with the transformation vector in but not limited to, ESAW agar medium comprising nourseothricin. Growth media suitable for *Thalassiosira pseudonana* lipid production include, but are not limited to, ESAW medium, and those culture media discussed by Volkman et al. and Harrison et al. Evaluation of fatty acid profiles of *Thalassiosira pseudonana* lipids may be assessed through standard lipid extraction and analytical methods described herein.

Example 30

Engineering *Chlamydomonas Reinhardtii*

Expression of recombinant genes in accordance with the present invention in *Chlamydomonas reinhardtii* may be accomplished by modifying the methods and vectors taught by Cerutti et al. as discussed herein. Briefly, Cerutti et al., *Genetics*, Vol. 145:1 (1997), pp. 97-110, reported the stable nuclear transformation of *Chlamydomonas reinhardtii* with a transformation vector. Using the transformation method of microprojectile bombardment, Cerutti introduced transformation construct P[1030] into *Chlamydomonas reinhardtii*. Construct P[1030] comprised a spectinomycin resistance cassette, comprising sequence encoding the aminoglucoside 3"-adenyltransferase (aadA) gene product operably linked to the *Chlamydomonas reinhardtii* ribulose-1,5-bisphosphate carboxylase/oxygenase small subunit gene (RbcS2, GenBank Accession No. X04472) promoter upstream of the aadA protein-coding region and operably linked to the *Chlamydomonas reinhardtii* RbcS2 gene 3' UTR/terminator at the 3' region (downstream of the aadA protein coding-sequence). The aadA gene product confers resistance to the antibiotic spectinomycin. Prior to transformation with P[1030], *Chlamydomonas reinhardtii* was unable to propagate on medium comprising 90 ug/ml spectinomycin. Upon transformation with P[1030], transformants of *Chlamydomonas reinhardtii* were obtained that were propagated in selective culture medium comprising 90 ug/ml spectinomycin, thereby establishing the utility of the spectinomycin antibiotic resistance cassette as a selectable marker for use in *Chlamydomonas reinhardtii*. Evaluation of the genomic DNA of the stable transformants was performed by Southern analysis. Cerutti reported that selection and maintenance of the transformed *Chlamydomonas reinhardtii* was performed on agar plates comprising Tris-acetate-phosphate medium (TAP, as described by Harris, The *Chlamydomonas Sourcebook*, Academic Press, San Diego, 1989) with 90 ug/ml spectinomycin. Cerutti additionally reported propagation of *Chlamydomonas reinhardtii* in TAP liquid culture with 90 ug/ml spectinomycin. Propagation of *Chlamydomonas reinhardtii* in alternative culture medium has been discussed (for example in Dent et al., *African Journal of Microbiology Research*, Vol. 5:3 (2011), pp. 260-270 and Yantao et al., *Biotechnology and Bioengineering*, Vol. 107:2 (2010), pp. 258-268). Additional constructs, comprising additional selectable markers suitable for use in *Chlamydomonas reinhardtii* as well as numerous regulatory sequences, including protomers and 3' UTRs suitable for promoting heterologous gene expression in *Chlamydomonas reinhardtii* are known in the art and have been discussed (for a review, see Radakovits et al., *Eurkaryotic Cell*, Vol. 9:4 (2010), pp. 486-501). Cerutti reported that the transformation vector P[1030] and the *Chlamydomonas reinhardtii* promoter and 3' UTR/terminator are suitable to enable exogenous gene expression in *Chlamydomonas reinhardtii*. In addition, Cerutti reported that the spectinomycin resistance cassette encoded on P[1030] was suitable for use as a selectable marker in *Chlamydomonas reinhardtii*.

In an embodiment of the present invention, vector P[1030], comprising the nucleotide sequence encoding the aadA gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Chlamydomonas reinhardtii* to reflect the codon bias inherent in nuclear genes of *Chlamydomonas reinhardtii* in accordance with Tables 24A-D. For each lipid biosynthesis pathway protein of Table 25, the codon-optimized gene sequence can individually be operably linked to the *Chlamydomonas reinhardtii* RbcS2 promoter upstream of the protein-coding sequence and operably linked to the *Chlamydomonas reinhardtii* RbcS2 3'UTR/terminator at the 3' region, or downstream, of the protein-coding sequence. The transformation construct may additionally comprise homology regions to the *Chlamydomonas reinhardtii* genome for targeted genomic integration of the transformation vector. Homology regions may be selected to disrupt one or more genomic site of an endogenous lipid biosynthesis pathway gene. One skilled in the art can identify such homology regions within the sequence of the *Chlamydomonas reinhardtii* genome (referenced in the publication by Merchant et al., *Science*, Vol. 318:5848 (2007), pp. 245-250). Stable transformation of *Chlamydomonas reinhardtii* with the transformation vector is achieved through well-known transformation techniques including microprojectile bombardment or other known methods. Activity of the aadA gene product may be used as a marker to select for *Chlamydomonas reinhardtii* transformed with the transformation vector on, but not limited to, TAP agar medium comprising spectinomycin. Growth media suitable for *Chlamydomonas reinhardtii* lipid production include, but are not limited to, ESAW medium, and those culture media discussed by Yantao et al. and Dent et al. Evaluation of fatty acid profiles of *Chlamydomonas reinhardtii* lipids may be assessed through standard lipid extraction and analytical methods described herein.

Example 31

Engineering *Yarrowia Lipolytica*

Expression of recombinant genes in accordance with the present invention in *Yarrowia lipolytica* may be accomplished by modifying the methods and vectors taught by Fickers et al. as discussed herein. Briefly, Fickers et al., *Journal of Microbiological Methods*, Vol. 55 (2003), pp. 727-737, reported the stable nuclear transformation of *Yarrowia lipolytica* with plasmid DNA. Using a lithium acetate transformation method, Fickers introduced the plasmid JMP123 into *Yarrowia lipolytica*. Plasmid JMP123 comprised a hygromycin B resistance cassette, comprising sequence encoding the hygromycin B phosphotransferase gene product (hph), operably-linked to the *Yarrowia lipolytica* LIP2 gene promoter (GenBank Accession No. AJ012632) upstream of the hph protein-coding region and operably linked to the *Yarrowia lipolytica* LIP2 gene 3'UTR/terminator downstream of the hph protein-coding region. Prior to transformation with JMP123, *Yarrowia lipolytica* were unable to propagate on medium comprising 100 ug/ml hygromycin. Upon transformation with JMP123, transformed *Yarrowia lipolytica* were obtained that were able to propagate on medium comprising 100 ug/ml hygromycin, thereby establishing the hygromycin B antibiotic resistance cassette as a selectable marker for use in *Yarrowia lipolytica*. The nucleotide sequence provided on JMP123 of the promoter and 3'UTR/terminator of the *Yarrowia lipolytica* LIP2 gene served as donor sequences for homologous recombination of the hph coding sequence into the LIP2 locus. Evaluation of the genomic DNA of the stable transformants was performed by Southern. Fickers reported that selection and maintenance of the transformed *Yarrowia lipolytica* was performed on agar plates comprising standard YPD medium (Yeast Extract Peptone Dextrose) with 100 ug/ml hygromycin. Liquid culturing of transformed *Yarrowia lipolytica* was performed in YPD medium with hygromycin. Other media and techniques used for culturing *Yarrowia lipolytica* have been reported and numerous other plasmids, promoters, 3' UTRs, and selectable markers for use in *Yarrowia lipolytica* have been reported (for example see Pignede et al., *Applied and Environmental Biology*, Vol. 66:8 (2000), pp. 3283-3289, Chuang et al., *New Biotechnology*, Vol. 27:4 (2010), pp. 277-282, and Barth and Gaillardin, (1996), In: K,W. (Ed.), Nonconventional Yeasts in Biotecnology. Sprinter-Verlag, Berlin-Heidelber, pp. 313-388). Fickers reported that the transformation vector JMP123 and the *Yarrowia lipolytica* LIP2 gene promoter and 3' UTR/terminator are suitable to enable heterologous gene expression in *Yarrowia lipolytica*. In addition, Fickers reported that the hygromycin resistance cassette encoded on JMP123 was suitable for use as a selectable marker in *Yarrowia lipolytica*.

In an embodiment of the present invention, vector JMP123, comprising the nucleotide sequence encoding the hph gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Yarrowia lipolytica* to reflect the codon bias inherent in nuclear genes of *Yarrowia lipolytica* in accordance with Tables 24A-D. For each lipid biosynthesis pathway protein of Table 25, the codon-optimized gene sequence can individually be operably linked to the *Yarrowia lipolytica* LIP2 gene promoter upstream of the protein-coding sequence and operably linked to the *Yarrowia lipolytica* LIP2 gene 3'UTR/terminator at the 3' region, or downstream, of the protein-coding sequence. The transformation construct may additionally comprise homology regions to the *Yarrowia lipolytica* genome for targeted genomic integration of the transformation vector. Homology regions may be selected to disrupt one or more genomic sites of endogenous lipid biosynthesis pathway genes. One skilled in the art can identify such homology regions within the sequence of the *Yarrowia lipolytica* genome (referenced in the publication by Dujun et al., *Nature*, Vol. 430 (2004), pp. 35-44). Stable transformation of *Yarrowia lipolytica* with the transformation vector is achieved through well-known transformation techniques including lithium acetate transformation or other known methods. Activity of the hph gene product may be used as a marker to select for *Yarrowia lipolytica* transformed with the transformation vector on, but not limited to, YPD medium comprising hygromycin. Growth media suitable for *Yarrowia lipolytica* lipid production include, but are not limited to, YPD medium, and those culture media described by Chuang et al. Evaluation of fatty acid profiles of *Yarrowia lipolytica* lipids may be assessed through standard lipid extraction and analytical methods described herein.

Example 32

Engineering *Mortierella Alpine*

Expression of recombinant genes in accordance with the present invention in *Mortierella alpine* may be accomplished by modifying the methods and vectors taught by Mackenzie et al. as discussed herein. Briefly, Mackenzie et al., *Applied and Environmental Microbiology*, Vol. 66 (2000), pp. 4655-4661, reported the stable nuclear transformation of *Mortierella alpina* with plasmid DNA. Using a protoplast transformation method, MacKenzie introduced the plasmid pD4 into *Mortierella alpina*. Plasmid pD4 comprised a hygromycin B resistance cassette, comprising sequence encoding the hygromycin B phosphotransferase gene product (hpt), operably-linked to the *Mortierella alpina* histone H4.1 gene promoter (GenBank Accession No. AJ249812) upstream of the hpt protein-coding region and operably linked to the *Aspergillus nidulans* N-(5'-phosphoribosyl)anthranilate isomerase (trpC) gene 3'UTR/terminator downstream of the hpt protein-coding region. Prior to transformation with pD4, *Mortierella alpina* were unable to propagate on medium comprising 300 ug/ml hygromycin. Upon transformation with pD4, transformed *Mortierella alpina* were obtained that were propagated on medium comprising 300 ug/ml hygromycin, thereby establishing the hygromycin B antibiotic resistance cassette as a selectable marker for use in *Mortierella alpina*. Evaluation of the genomic DNA of the stable transformants was performed by Southern. Mackenzie reported that selection and maintenance of the transformed *Mortierella alpina* was performed on PDA (potato dextrose agar) medium comprising hygromycin. Liquid culturing of transformed *Mortierella alpina* by Mackenzie was performed in PDA medium or in S2GYE medium (comprising 5% glucose, 0.5% yeast extract, 0.18% $NH_4SO_4$, 0.02% $MgSO_4$-$7H_2O$, 0.0001% $FeCl_3$-$6H_2O$, 0.1%, trace elements, 10 mM $K_2HPO_4$—$NaH_2PO_4$), with hygromycin. Other media and techniques used for culturing *Mortierella alpina* have been reported and other plasmids, promoters, 3' UTRs, and selectable markers for use in *Mortierella alpina* have been reported (for example see Ando et al., *Applied and Environmental Biology*, Vol. 75:17 (2009) pp. 5529-35 and Lu et al., *Applied Biochemistry and Biotechnology*, Vol. 164:7 (2001), pp. 979-90). Mackenzie reported that the transformation vector pD4 and the *Mortierella alpina* histone H4.1 promoter and *A. nidulans* trpC gene 3' UTR/terminator are suitable to enable heterologous gene expression in *Mortierella alpina*. In addition, Mackenzie reported that the hygromycin resistance cassette encoded on pD4 was suitable for use as a selectable marker in *Mortierella alpina*.

In an embodiment of the present invention, vector pD4, comprising the nucleotide sequence encoding the hpt gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Mortierella alpina* to reflect the codon bias inherent in nuclear genes of *Mortierella alpina* in accordance with Tables 24A-D. For each lipid biosynthesis pathway protein of Table 25, the codon-optimized gene sequence can individually be operably linked to the *Mortierella alpina* histone H4.1 gene promoter upstream of the protein-coding sequence and operably linked to the *A. nidulans* trpC 3'UTR/terminator at the 3' region, or downstream, of the protein-coding sequence. The transformation construct may additionally comprise homology regions to the *Mortierella alpina* genome for targeted genomic integration of the transformation vector. Homology regions may be selected to disrupt one or more genomic sites of endogenous lipid biosynthesis pathway genes. One skilled in the art can identify such homology regions within the sequence of the *Mortierella alpina* genome (referenced in the publication by Wang et al., PLOS One, Vol. 6:12 (2011)). Stable transformation of *Mortierella alpina* with the transformation vector is achieved through well-known transformation techniques including protoplast transformation or other known methods. Activity of the hpt gene product may be used as a marker to select for *Mortierella alpina* transformed with the transformation vector on, but not limited to, PDA medium comprising hygromycin. Growth media suitable for *Mortierella alpina* lipid production include, but are not limited to, S2GYE medium, and those culture media described by Lu et al. and Ando et al. Evaluation of fatty acid profiles of *Mortierella alpina* lipids may be assessed through standard lipid extraction and analytical methods described herein.

Example 33

Engineering *Rhodococcus Opacus* PD630

Expression of recombinant genes in accordance with the present invention in *Rhodococcus opacus* PD630 may be accomplished by modifying the methods and vectors taught by Kalscheuer et al. as discussed herein. Briefly, Kalscheuer et al., *Applied and Environmental Microbiology*, Vol. 52 (1999), pp. 508-515, reported the stable transformation of *Rhodococcus opacus* with plasmid DNA. Using the transformation method of electroporation, Kalscheuer introduced the plasmid pNC9501 into *Rhodococcus opacus* PD630. Plasmid pNC9501 comprised a thiostrepton resistance (thio$^r$) cassette, comprising the full nucleotide sequence of the *Streptomyces azureus* 23S rRNA A1067 methyltransferase gene, including the gene's promoter and 3' terminator sequence. Prior to transformation with pNC9501, *Rhodococcus opacus* was unable to propagate on medium comprising 1 mg/ml thiostrepton. Upon transformation of *Rhodococcus opacus* PD630 with pNC9501, transformants were obtained that propagated on culture medium comprising 1 mg/ml thiostrepton, thereby establishing the use of the thiostrepton resistance cassette as a selectable marker in *Rhodococcus opacus* PD630. A second plasmid described by Kalscheuer, pAK68, comprised the resistance thio$^r$ cassette as well as the gene sequences of the *Ralstonia eutropha* beta-ketothiolase (phaB), acetoacetyl-CoA reductase (phaA), and poly3-hydroxyalkanoic acid synthase (phaC) genes for polyhydroxyalkanoate biosynthesis, driven by the lacZ promoter. Upon pAK68 transformation of a *Rhodococcus opacus* PD630 strain deficient in polyhydroxyalkanoate biosynthesis, transformed *Rhodococcus opacus* PD630 were obtained that produced higher amounts of polyhydroxyalkanoates than the untransformed strain. Detectable activity of the introduced Ralstonia eutropha phaB, phaA, and phaC enzymes indicted that the regulatory elements encoded on the pAK68 plasmid were suitable for heterologous gene expression in *Rhodococcus opacus* PD630. Kalscheuer reported that selection and maintenance of the transformed *Rhodococcus opacus* PD630 was performed on standard Luria Broth (LB) medium, nutrient broth (NB), or mineral salts medium (MSM) comprising thiostrepton. Other media and techniques used for culturing *Rhodococcus opacus* PD630 have been described (for example see Kurosawa et al., *Journal of Biotechnology*, Vol. 147:3-4 (2010), pp. 212-218 and Alverez et al., *Applied Microbial and Biotechnology*, Vol. 54:2 (2000), pp. 218-223). Kalscheuer reported that the transformation vectors pNC9501 and pAK68, the promoters of the *Streptomyces azureus* 23S rRNA A1067 methyltransferase gene and lacZ gene are suitable to enable heterologous gene expression in *Rhodococcus opacus* PD630. In addition, Kalscheuer reported that the thio$^r$ cassette encoded on pNC9501 and pAK68 was suitable for use as a selectable marker in *Rhodococcus opacus* PD630.

In an embodiment of the present invention, vector pNC9501, comprising the nucleotide sequence encoding the thio$^r$ gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 25, each protein-coding sequence codon-optimized for expression in *Rhodococcus opacus* PD630 to reflect the codon bias inherent in nuclear genes of *Rhodococcus opacus* in accordance with Tables 24A-D. For each lipid biosynthesis pathway protein of Table 25, the codon-optimized gene sequence can individually be operably linked to the lacZ gene promoter upstream of the protein-coding sequence. The transformation construct may additionally comprise homology regions to the *Rhodococcus opacus* PD630 genome for targeted genomic integration of the transformation vector. Homology regions may be selected to disrupt one or more genomic sites of endogenous lipid biosynthesis pathway genes. One skilled in the art can identify such homology regions within the sequence of the *Rhodococcus opacus* PD630 genome (referenced in the publication by Holder et al., *PLOS Genetics*, Vol. 7:9 (2011). Transformation of *Rhodococcus opacus* PD630 with the transformation vector is achieved through well-known transformation techniques including electoporation or other known methods. Activity of the *Streptomyces azureus* 23S rRNA A1067 methyltransferase gene product may be used as a marker to select for *Rhodococcus opacus* PD630 transformed with the transformation vector on, but not limited to, LB medium comprising thiostrepton. Growth media suitable *Rhodococcus opacus* PD630 lipid production include, but are not limited to those culture media discussed by Kurosawa et al. and Alvarez et al. Evaluation of fatty acid profiles of *Rhodococcus opacus* PD630 lipids may be assessed through standard lipid extraction and analytical methods described herein.

Example 34

Engineering Microalgae for Fatty Acid Auxotrophy

*Prototheca moriformis* (UTEX 1435) engineered to express a *Cuphea wrightii* thioesterase (CwTE2), was used as the host organism for further genetic modification to knockout both endogenous thioesterase alleles, FATA1-1 and FATA1-2. Here, a first transformation construct was generated to integrate a neomycin expression cassette at the FATA1-1 locus. This construct, pSZ2226, included 5' (SEQ ID NO: 150) and 3' (SEQ ID NO: 151) homologous recombination targeting sequences (flanking the construct) to the FATA1-1 locus of the nuclear genome and a neomycin resistance protein-coding sequence under the control of the *C. reinhardtii* β-tubulin promoter/5'UTR (SEQ ID NO: 5) and the *Chlorella vulgaris* nitrate reductase 3' UTR (SEQ ID NO: 126). This NeoR expression cassette is listed as SEQ ID NO: 135 and served as a selectable marker.

Upon transformation of pSZ2226, individual transformants were selected on agar plates comprising sucrose and G418. A single isolate, Strain H, was selected for further genetic modification. A second transformation construct, pSZ2236, was generated to integrate polynucleotides enabling expression of a thiamine selectable marker into Strain H at the FATA1-2 locus. pSZ2236 included 5' (SEQ ID NO: 152) and 3' (SEQ ID NO: 153) homologous recombination targeting sequences (flanking the construct) to the FATA1-2 genomic region for integration into the *P. moriformis* nuclear genome and an *A. thaliana* THIC protein coding region under the control of the *C. protothecoides* actin promoter/5'UTR (SEQ ID NO: 142) and *C. vulgaris* nitrate reductase 3' UTR (SEQ ID NO: 126). This AtTHIC expression cassette is listed as SEQ ID NO: 143 and served as a selectable marker. Upon transformation of Strain H with pSZ2236 to generate Strain I, individual transformants, were selected on agar plates comprising free fatty acids. Strain I was able to propagate on agar plates and in medium lacking thiamine and supplemented with free fatty acids.

Example 35

Engineering Microorganisms for Increased Production of Stearic Acid

A classically mutagenized strain of *Prototheca moriformis* (UTEX 1435), Strain J, was transformed with the plasmid construct pSZ2281 according to biolistic transformation methods as described herein and in PCT/US2009/066141, PCT/US2009/066142, PCT/US2011/038463, PCT/US2011/038464, and PCT/US2012/023696. pSZ2281 included polynucleotides encoding RNA hairpins (SAD2hpC, SEQ ID NO: 154) to down-regulate the expression of stearoyl-ACP desaturase, 5' (SEQ ID NO: 121) and 3' (SEQ ID NO: 122) homologous recombination targeting sequences (flanking the construct) to the 6S genomic region for integration into the nuclear genome, and a *S. cerevisiae* suc2 sucrose invertase coding region (SEQ ID NO: 124), to express the protein sequence given in SEQ ID NO: 123, under the control of *C. reinhardtii* β-tubulin promoter/5'UTR (SEQ ID NO: 125) and *Chlorella vulgaris* nitrate reductase 3' UTR (SEQ ID NO: 126). This *S. cerevisiae* suc2 expression cassette is listed as SEQ ID NO: 127 and served as a selectable marker. The polynucleotide sequence encoding the SAD2hpC RNA hairpin was under the control of the *C. protothecoides* actin promoter/5'UTR (SEQ ID NO: 142) and *C. vulgaris* nitrate reductase 3' UTR (SEQ ID NO: 126).

Upon transformation of Strain J with construct pSZ2281 thereby generating Strain K, positive clones were selected on agar plates containing sucrose as a sole carbon source. Individual transformants were clonally purified and propagated under heterotrophic conditions suitable for lipid production as those detailed herein and in PCT/US2009/066141, PCT/US2009/066142, PCT/US2011/038463, PCT/US2011/038464, and PCT/US2012/023696. Lipid samples were prepared from dried biomass and analyzed using standard fatty acid methyl ester gas chromatography flame ionization detection methods as described in Example 3 (also see PCT/US2012/023696). The fatty acid profiles (expressed as Area % of total fatty acids) of *P. moriformis* UTEX Strain J propagated on glucose as a sole carbon source and three representative isolates of Strain K, propagated on sucrose as a sole carbon source, are presented in Table 26.

TABLE 26

Fatty acid profiles of *Prototheca moriformis* cells engineered to express a hairpin RNA construct targeting stearoyl ACP desaturase gene/gene products.

| Area % Fatty acid | Strain J | Strain K-1 | Strain K-2 | Strain K-3 |
|---|---|---|---|---|
| C10:0 | 0.01 | 0.00 | 0.02 | 0.02 |
| C12:0 | 0.03 | 0.05 | 0.05 | 0.05 |
| C14:0 | 1.22 | 0.89 | 0.87 | 0.77 |

TABLE 26-continued

Fatty acid profiles of *Prototheca moriformis* cells engineered to express a hairpin RNA construct targeting stearoyl ACP desaturase gene/gene products.

| Area % Fatty acid | Strain J | Strain K-1 | Strain K-2 | Strain K-3 |
|---|---|---|---|---|
| C16:0 | 26.75 | 29.23 | 28.96 | 27.55 |
| C18:0 | 3.06 | 37.39 | 36.76 | 36.41 |
| C18:1 | 59.62 | 23.90 | 24.76 | 26.92 |
| C18:2 | 7.33 | 5.44 | 5.54 | 5.54 |

The data presented in Table 26 show a clear impact of the expression of a SAD2 hairpin RNA construct on the C18:0 and C18:1 fatty acid profiles of the transformed organism. The fatty acid profiles of Strain K transformants comprising a SAD2 hairpin RNA construct demonstrated an increase in the percentage of saturated C18:0 fatty acids with a concomitant diminution of unsaturated C18:1 fatty acids. Fatty acid profiles of the untransformed strain comprise about 3% C18:0. Fatty acid profiles of the transformed strains comprise about 37% C18:0. These data illustrate the successful expression and use of polynucleotides enabling expression of a SAD RNA hairpin construct in *Prototheca moriformis* to alter the percentage of saturated fatty acids in the engineered host microbes, and in particular in increasing the concentration of C18:0 fatty acids and decreasing C18:1 fatty acids in microbial cells.

Example 36

Engineering Microorganisms for Increased Production of Oleic Acid through Knockdown of an Endogenous Acyl-ACP Thioesterase A classically mutagenized strain of *Prototheca moriformis* (UTEX 1435), Strain J, was transformed independently with each of the constructs pSZ2402-pSZ2407 according to biolistic transformation methods as described herein and in PCT/US2009/066141, PCT/US2009/066142, PCT/US2011/038463, PCT/US2011/038464, and PCT/US2012/023696. Each of the constructs pSZ2402-pSZ2407 included different polynucleotides encoding a hairpin RNA targeted against *Prototheca moriformis* FATA1 mRNA transcripts to down-regulate the expression of fatty acyl-ACP thioesterase, 5' (SEQ ID NO: 121) and 3' (SEQ ID NO: 122) homologous recombination targeting sequences (flanking the construct) to the 6S genomic region for integration into the nuclear genome, and a *S. cerevisiae* suc2 sucrose invertase coding region (SEQ ID NO: 124) to express the protein sequence given in SEQ ID NO: 123 under the control of *C. reinhardtii* β-tubulin promoter/5'UTR (SEQ ID NO: 125) and *Chlorella vulgaris* nitrate reductase 3' UTR (SEQ ID NO: 126). This *S. cerevisiae* suc2 expression cassette is listed as SEQ ID NO: 127 and served as a selectable marker. Sequence listing identities for the polynucleotides corresponding to each hairpin are listed in Table 27. The polynucleotide sequence encoding each RNA hairpin was under the control of the *C. reinhardtii* β-tubulin promoter/5'UTR (SEQ ID NO: 125) and *C. vulgaris* nitrate reductase 3' UTR (SEQ ID NO: 126).

TABLE 27

Plasmid constructs used to transform *Prototheca moriformis* (UTEX 1435) Strain J.

| 1. Plasmid construct | 2. Hairpin designation | 3. SEQ ID NO: |
|---|---|---|
| 4. pSZ2402 | 5. PmFATA-hpB | 6. SEQ ID NO: 160 |
| 7. pSZ2403 | 8. PmFATA-hpC | 9. SEQ ID NO: 161 |
| 10. pSZ2404 | 11. PmFATA-hpD | 12. SEQ ID NO: 162 |
| 13. pSZ2405 | 14. PmFATA-hpE | 15. SEQ ID NO: 163 |
| 16. pSZ2406 | 17. PmFATA-hpF | 18. SEQ ID NO: 164 |
| 19. pSZ2407 | 20. PmFATA-hpG | 21. SEQ ID NO: 165 |

Upon independent transformation of Strain J with each of the constructs listed in Table 27, positive clones were selected on agar plates containing sucrose as a sole carbon source. Individual transformants were clonally purified and propagated under heterotrophic conditions suitable for lipid production as those detailed in PCT/US2009/066141, PCT/US2009/066142, PCT/US2011/038463, PCT/US2011/038464, and PCT/US2012/023696. Lipid samples were prepared from dried biomass and analyzed using standard fatty acid methyl ester gas chromatography flame ionization detection methods as described in Example 3. The fatty acid profiles (expressed as Area % of total fatty acids) of *P. moriformis* UTEX Strain J propagated on glucose as a sole carbon source and representative isolates of each transformation of Strain J, propagated on sucrose as a sole carbon source, are presented in Table 28.

TABLE 28

Fatty acid profiles of *Prototheca moriformis* cells engineered to express hairpin RNA constructs targeting fatty acyl-ACP thioesterase gene/gene products.

| | Area % Fatty Acid | | | | | | |
|---|---|---|---|---|---|---|---|
| Construct | C10:0 | C12:0 | C14:0 | C16:0 | C18:0 | C18:1 | C18:2 |
| Strain J untransformed | 0 | 0.05 | 1.32 | 26.66 | 3.1 | 59.07 | 7.39 |
| PmFATA-hpB | 0.04 | 0.07 | 1.36 | 24.88 | 2.24 | 61.92 | 6.84 |
| | 0 | 0.08 | 1.33 | 25.34 | 2.39 | 61.72 | 6.5 |
| | 0 | 0.07 | 1.29 | 25.44 | 2.26 | 61.7 | 6.69 |
| | 0 | 0.06 | 1.33 | 25.1 | 2.37 | 61.56 | 6.87 |
| PmFATA-hpC | 0 | 0.08 | 1.18 | 22.03 | 1.71 | 63.8 | 8.63 |
| | 0 | 0.07 | 1.21 | 24.5 | 2.23 | 62.32 | 7.19 |
| | 0 | 0.08 | 1.29 | 24.93 | 2.24 | 62.02 | 7.01 |
| | 0.05 | 0.06 | 1.29 | 25.45 | 2.26 | 61.81 | 6.76 |
| PmFATA-hpD | 0 | 0.02 | 0.68 | 15.8 | 1.88 | 72.64 | 6.96 |
| | 0 | 0.03 | 0.78 | 17.56 | 1.7 | 71.8 | 6.03 |
| | 0 | 0.03 | 0.92 | 19.04 | 2.03 | 68.82 | 7.05 |
| | 0 | 0.04 | 1.27 | 23.14 | 2.25 | 65.27 | 6.07 |
| PmFATA-hpE | 0 | 0.03 | 0.79 | 18.55 | 2.13 | 69.66 | 6.77 |
| | 0 | 0.04 | 1.11 | 21.01 | 1.74 | 65.18 | 8.55 |
| | 0 | 0.03 | 1.08 | 21.11 | 1.54 | 64.76 | 8.87 |
| | 0 | 0.03 | 1.17 | 21.93 | 1.71 | 63.89 | 8.77 |
| PmFATA-hpF | 0.03 | 0.04 | 0.34 | 8.6 | 1.69 | 78.08 | 8.87 |
| | 0 | 0.03 | 0.49 | 10.2 | 1.52 | 76.97 | 8.78 |
| | 0 | 0.03 | 1 | 20.47 | 2.22 | 66.34 | 7.45 |
| | 0 | 0.03 | 1.03 | 21.61 | 1.88 | 65.39 | 7.76 |
| PmFATA-hpG | 0 | 0.03 | 1.03 | 20.57 | 2.36 | 64.73 | 8.75 |
| | 0 | 0.03 | 1.2 | 24.39 | 2.47 | 61.9 | 7.49 |
| | 0 | 0.04 | 1.29 | 24.14 | 2.29 | 61.41 | 8.22 |

The data presented in Table 28 show a clear impact of the expression of FATA hairpin RNA constructs on the C18:0 and C18:1 fatty acid profiles of the transformed organism. The fatty acid profiles of Strain J transformants comprising a FATA hairpin RNA construct demonstrated an increase in the percentage of C18:1 fatty acids with a concomitant diminution of C16:0 and C18:0 fatty acids. Fatty acid profiles of the untransformed Strain J are about 26.66% C16:0, 3% C18:0, and about 59% C18:1 fatty acids. In contrast, the fatty acid profiles of the transformed strains comprise as low as 8.6% C16:0 and 1.54% C18:0 and greater than 78% C18:1 fatty acids. These data indicate that FATA1 enzyme of *Prototheca moriformis* (UTEX 1435) displays a preferential specificity for hydrolysis of fatty acids of length C18.

These data illustrate the utility and successful use of polynucleotide FATA RNA hairpin constructs in *Prototheca moriformis* to alter the fatty acids profile of engineered microbes, and in particular in increasing the concentration of C18:1 fatty acids and decreasing C18:0 and C16:0 fatty acids in microbial cells.

Example 37

Altering the Levels of Fatty Acids of Engineered Microbes through Multiple Allelic Disruption of a Fatty Acid Desaturase This example describes the use of a transformation vector to disrupt the FADc loci of *Prototheca moriformis* with a transformation cassette comprising a selectable marker and sequence encoding an exogenous SAD enzyme to engineer microorganisms in which the fatty acid profile of the transformed microorganism has been altered.

A classically mutagenized (for higher oil production) derivative of *Protheca moriformis* (UTEX 1435), strain A, was transformed with the transformation construct pSZ1499 (SEQ ID NO: 246) according to biolistic transformation methods detailed in Example 2. pSZ1499 comprised nucleotide sequence of the *Olea europaea* stearoyl-ACP desaturase gene, codon-optimized for expression in *Protheca moriformis* UTEX 1435. The pSZ1499 expression construct contained 5' (SEQ ID NO: 247) and 3' (SEQ ID NO: 248) homologous recombination targeting sequences (flanking the construct) to the FADc genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *Olea europaea* stearoyl-ACP desaturase coding region was under the control of the *Prototheca moriformis* Amt03 promoter/5'UTR (SEQ ID NO: 89) and *C. vulgaris* nitrate reductase 3'UTR, and the native transit peptide was replaced with the *Chlorella protothecoides* stearoyl-ACP desaturase transit peptide (SEQ ID NO: 49). The entire *O. europaea* SAD expression cassette was termed pSZ1499 and may be written as FADc5'_btub-Suc2-nr_amt03-S106SAD-OeSAD-nr-FADc3'.

Primary transformants were selected on plates containing sucrose as a sole carbon source. Individual transformants were clonally purified and grown under standard lipid production conditions at pH 7.0, similar to the conditions as disclosed in Example 1. Fatty acid profiles were analyzed using standard fatty acid methyl ester gas chromatography flame ionization (FAME GC/FID) detection methods as described in Example 3. The resulting fatty acid profiles from a set of representative clones arising from the transformations of the transformation vector are shown in Table 29. Fatty acid profiles of lipids obtained from the untransformed strain C strain grown under lipid production conditions comprising glucose as a sole carbon source (pH 5.0) are additionally presented in Table 29.

TABLE 29

Fatty acid profiles of *Prototheca moriformis* (UTEX 1435) multiply engineered to knockout endogenous FADc alleles and to express an *O. europaea* stearoyl-ACP desaturase.

| Strain | Transformant | % C16:0 | % C18:0 | % C18:1 | % C18:2 |
|---|---|---|---|---|---|
| strain A | untransformed | 28.50 | 3.72 | 57.70 | 7.04 |
| strain A | untransformed | 28.57 | 3.69 | 57.61 | 7.07 |
| strain A pSZ1499 | Transformant 1 | 20.37 | 1.13 | 74.38 | 0.01 |
| | Transformant 2 | 19.98 | 1.16 | 74.60 | 0.00 |
| | Transformant 3 | 20.10 | 1.16 | 74.70 | 0.00 |
| | Transformant 4 | 21.13 | 1.21 | 73.86 | 0.00 |
| | Transformant 5 | 19.95 | 1.11 | 74.58 | 0.00 |
| | Transformant 6 | 20.20 | 1.14 | 74.61 | 0.00 |
| | Transformant 7 | 20.72 | 1.15 | 74.15 | 0.00 |
| | Transformant 8 | 20.06 | 1.11 | 74.44 | 0.00 |
| | Transformant 9 | 19.86 | 1.18 | 74.88 | 0.00 |

As shown in Table 29, transformation of strain C with pSZ1499 impacts the fatty acid profiles of the transformed microbes. The untransformed *Prototheca moriformis* (UTEX 1435) strain C strain exhibits a fatty acid profile comprising less than 60% C18:1 fatty acids and greater than 7% C18:2 fatty acids. In contrast, strain C strains transformed with pSZ1499 exhibited fatty acid profiles with an increased composition of C18:1 fatty acids and a concomitant decrease in C18:0 and C18:2 fatty acids. C18:2 fatty acids were undetected in the fatty acid profiles of strain C transformed with pSZ1499. The absence of detectable C18:2 fatty acids in pSZ1499 transformants indicated that the transformation with pSZ1499, bearing homologous recombination targeting sequences for integration into multiple FADc genomic loci, had abolished FAD activity.

Figure 2:
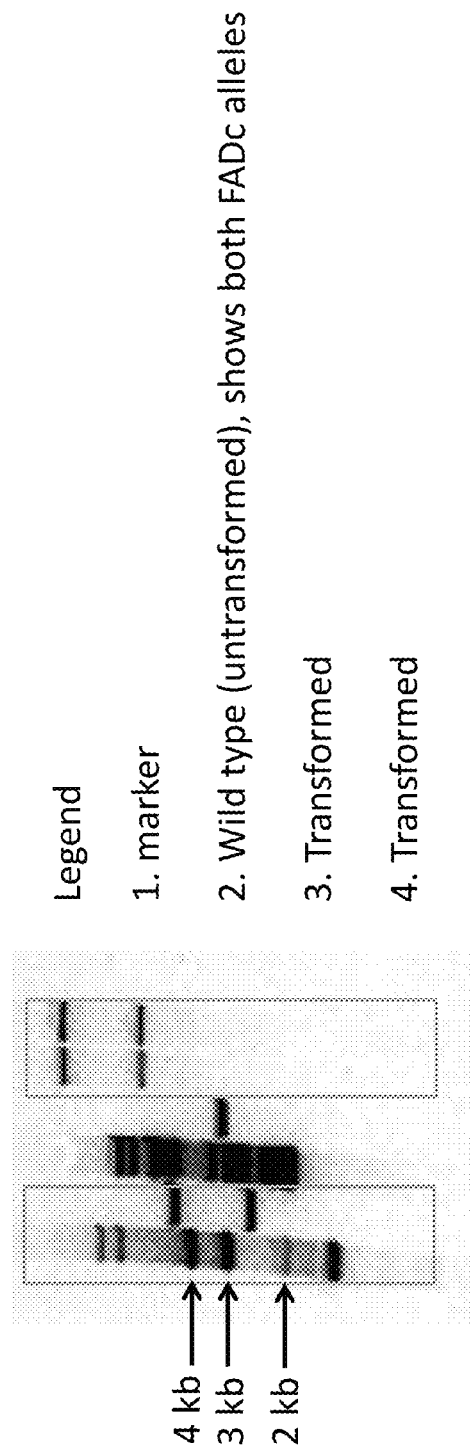
FIG. 2 shows the results of the Southern blot described in Example 37.

Southern blot analysis was conducted to verify that multiple FADc alleles were interrupted by the pSZ1499 transformation vector. Genomic DNA was extracted from strain C and pSZ1499 transformants using standard molecular biology methods. DNA from each sample was run on 0.8% agarose gels after digestion with the restriction enzyme PstI. DNA from this gel was transferred onto a Nylon+ membrane (Amersham), which was then hybridized with a P32-labeled polynucleotide probe corresponding to FADc 3' region. FIG. 1 shows maps of the pSZ1499 transformation cassette, the two sequenced FADc alleles of *Prototheca moriformis* (UTEX 1435), and the predicted sizes of the alleles disrupted by the pSZ1499 transformation vector. FADc allele 1 comprises a PstI restriction site, whereas FADc allele 2 does not. Integration of the SAD cassette would introduce a PstI restriction site into the disrupted FADc allele, resulting in a ~6 kb fragment resolved on the Southern, regardless of which allele was disrupted. FIG. 2 shows the results of Southern blot analysis. A hybridization band at ~6 kb is detected in both transformants. No smaller hybridization bands, that would be indicative of uninterrupted alleles, were detected. These results indicate that both FADc alleles were disrupted by pSZ1499.

The ablation of both alleles of the FADc fatty acid desaturase with a SAD expression cassette results in fatty acid profiles comprising about 74% C18:1. Collectively, these data demonstrate the utility and effectiveness of polynucleotides permitting knockout of FAD alleles and concomitant exogenous expression of stearoyl-ACP desaturase enzymes to alter the fatty acid profile of engineered microorganisms.

All references cited herein, including patents, patent applications, and publications, including Genbank Accession numbers, are hereby incorporated by reference in their entireties, whether previously specifically incorporated or not. The publications mentioned herein are cited for the purpose of describing and disclosing reagents, methodologies and concepts that may be used in connection with the present invention. Nothing herein is to be construed as an admission that these references are prior art in relation to the inventions described herein. In particular, the following patent applications are hereby incorporated by reference in their entireties for all purposes: PCT Application No. PCT/US2008/065563, filed Jun. 2, 2008, entitled "Production of Oil in Microorganisms", PCT Application No. PCT/US2010/31108, filed Apr. 14, 2010, entitled "Methods of Microbial Oil Extraction and Separation", PCT Publication No. WO 2010/063032, filed Nov. 30, 2009, entitled "Production of Tailored Oils in Heterotrophic Microorganisms", PCT Application No. PCT/US2011/038463, filed May 27, 2011, entitled "Tailored Oils Produced From Recombinant Heterotrophic Microorganisms", and PCT Application No. PCT/US/2012/023696, filed Feb. 2, 2012, entitled "Tailored Oils Produced from Recombinant Heterotrophic Microorganisms."

SEQUENCE LISTING (276 sequences)

SEQ ID NO: 1 - DNA, 541 bp, Prototheca kruegani
tgttgaagaatgagccggcgagttaaaaagagtggcatggttaaagaaaatactctggagccatagcgaaagcaagtttagtaagcttaggtcattctttttagacccgaaaccgagtgatctacccatgatcagggtgaagtgttagtaaaataacatggaggcccgaaccgactaatgttgaaaaattagcggatgaattgtgggtaggggcgaaaaaccaatcgaactcggagttagctggttctccccgaaatgcgtttaggcgcagcagtagcagtacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgtcaaaacctccagcaggttagcttagaagcagcaatcctttcaagagtgcgtaatagctcactg

SEQ ID NO: 2 - DNA, 573 bp, Prototheca wickerhamii
tgttgaagaatgagccggcgacttaaaataaatggcaggctaagagatttaataactcgaaacctaagcgaaagcaagtcttaatagggcgtcaatttaacaaaactttaaataaattataaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 3 - DNA, 541 bp, Prototheca stagnora
tgttgaagaatgagccggcgagttaaaaaaaatggcatggttaaagatatttctctgaagccatagcgaaagcaagttttacaagctatagtcattttttttagacccgaaaccgagtgatctacccatgatcagggtgaagtgttggtcaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggacgtgagtatgtcaaaacctccagcaggttagcttagaagcagcaatcctttcaagagtgcgtaatagctcactg

SEQ ID NO: 4 - DNA, 541 bp, Prototheca moriformis
tgttgaagaatgagccggcgagttaaaaagagtggcatggttaaagataattctctggagccatagcgaaagcaagtttaacaagctaaagtcaccctttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgttaaaacctccagcaggttagcttagaagcagcaatcctttcaagagtgcgtaatagctcactg

SEQ ID NO: 5 - DNA, 573 bp, Prototheca moriformis
tgttgaagaatgagccggcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 6 - DNA, 573 bp, Prototheca wickerhamii
tgttgaagaatgagccgtcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 7 - DNA, 541 bp, Prototheca moriformis
tgttgaagaatgagccggcgagttaaaaagagtggcgtggttaaagaaaattctctggaaccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggctccgaaagttgtacctcaaagtggcaaactctgaatactctatttagatatctactagtgagaccttgggggataagctccttggtcgaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 8 - DNA, 541 bp, Prototheca zopfii
tgttgaagaatgagccggcgagttaaaaagagtggcatggttaaagaaaattctctggagccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttctttcgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 9 - DNA, 565 bp, Prototheca moriformis
tgttgaagaatgagccggcgacttagaaaaggtggcatggttaaggaaatattccgaagccgtagcaaaagcgagtctgaatagggcgataaaatatattaatatttagaatctagtcattttttctagacccgaacccgggtgatctaaccatgaccaggatgaagcttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgagaacggtaccaaatcgtggcaaactctgaatactagaaatgacgatgtagtagtgagactgtgggggataagctccattgtcaagagggaaacagcccagaccaccagctaaggccccaaaatggtaatgtagtgacaaaggaggtgaaaatgcaaatacaaccaggaggttggcttagaagcagccatcctttaaagagtgcgtaatagctcactg

SEQ ID NO: 10 - DNA, 1187 bp, Parachlorella kessleri
gatcagacgggcctgacctgcgagataatcaagtgctcgtaggcaaccaactcagcagctgcttggtgttgggtctgcaggatagtgttgcagggccccaaggacagcaggggaacttacaccttgtccccgacccagttttatggagtgcattgcctcaagagcctagccggagcgctaggctacatacttgccgcaccggtatgaggggatatagtactcgcactgcgctgtctagtgagatgggcagtgctgcccataaacaactggctgctcagccatttgttggcggaccattctgggggggccagcaatgcctgactttcgggtagggtgaaaactgaacaaagactaccaaaacagaatttcttcctccttggaggtaagcgcaggccggcccgcctgcgcccacatggcgctccgaacacctccatagctgtaagggcgcaaacatggccggactgttgtcagcactctttcatggccatacaaggtcatgtcgagattagtgctgagtaagacactatcaccccatgttcgattgaagccgtgacttcatgccaacctgcccctgggcgtagcagacgtatgccatcatgaccactagccgacatgcgctgtcttttgccaccaaaacaactggtacaccgctcgaagtcgtgccgcacacctccgggagtgagtccggcgactcctccccggcgggccgcggccctacctgggtagggtcgccatacgcccacgaccaaacgacgcaggaggggattggggtagggaatcccaaccagcctaaccaagacggcacctataataataggtggggggactaacagccctatatcgcaagctttgggtgcctatcttgagaagcacgagttggagtggctgtgtacggtcgaccctaaggtgggtgtgccgcagcctgaaacaaagcgtctagcagctgcttctataatgtgtcagccgttgtgtttcagttatattgtatgctattgtttgttcgtgctagggtggcgcaggcccacctactgtggcgggccattggttggtgcttgaattgcctcaccatctaaggtctgaacgctcactcaaacgcctttgtacaactgcagaactttccttggcgctgcaactacagtgtgcaaaccagcacatagcactcccttacatcacccagcagtacaaca

SEQ ID NO: 11 - DNA, 1414 bp, Pseudochlorella pringsheimii
cgctgcgcaccagggccgccagctcgctgatgtcgctccaaatgcggtcccccgattttttgttcttcatcttctccaccttggtggccttcttggccagggccttcagctgcatgcgcacagaccgttgagctcctgatcagcatcctcaggaggccctttgacaagcaagcccctgtgcaagcccattcacggggtaccagtggtgctgaggtagatgggtttgaaaaggattgctcggtcgattgctgctcatggaattggcatgtgcatgcatgttcacaatatgccaccaggctttggagcaagagagcatgaatgccttcaggcaggttgaaagttcctgggggtgaagaggcagggccgaggattggaggaggaaagcatcaagtcgtcgctcatgctcatgttttcagtcagagtttgccaagctcacaggagcagagacaagactggctgctcaggtgttgcatcgtgtgtgtggtgggggggggggggttaatacggtacgaaatgcacttggaattcccacctcatgccagcggacccacatgcttgaattcgaggcctgtggggtgagaaatgctcactctgccctcgttgctgaggtacttcaggccgctgagctcaaagtcgatgccctgctcgtctatcagggcctgcacctctgggctgaccggctcagcctccttcgcgggcatggagtaggcgccggcagcgttcatgtccgggcccagggcagcggtggtgccataaatgtcggtgatggtggggaggggggccgtcgccacaccattgccgttgctggctgacgcatgcacatgtggcctggctggcaccggcagcactggtctccagccagccagcaagtggctgttcaggaaagcggccatgttgttggtccctgcgcatgtaattccccagatcaaaggagggaacagcttggatttgatgtagtgcccaaccggactgaatgtgcgatggcaggtccctttgagtctcccgaattactagcagggcactgtgacctaacgcagcatgccaaccgcaaaaaaatgattgacagaaaatgaagcggtgtgtcaatatttgctgtatttattcgttttaatcagcaaccaagttcgaaacgcaactatcgtggtgatcaagtgaacctcatcagacttacctcgttcggcaaggaaacggaggcaccaaattccaatttgatattatcgcttgccaagctagagctgatctttgggaaaccaactgccagacagtggactgtgatggagtgccccgagtggtggagcctcttcgattcggttagtcattactaacgtgaaccctcagtgaagggaccatcagaccagaaagaccagatctcctcctcgacaccgagagagtgttgcggcagtaggacgacaag

SEQ ID NO: 12 - protein, 20 aa, Unknown
  source: /note="Description of Unknown: Yeast secretion signal peptide"
MLLQAFLFLLAGFAAKISAS

SEQ ID NO: 13 - protein, 18 aa, Unknown
  source: /note="Description of Unknown: Higher plants secretion signal peptide"
MANKSLLLLLLLGSLASG

SEQ ID NO: 14 - protein, 10 aa, Unknown
  source: /note="Description of Unknown: Consensus eukaryotic secretion signal peptide"
MARLPLAALG

SEQ ID NO: 15 - protein, 20 aa, Unknown
  source: /note="Description of Unknown: Combination higher plant/eukaryotic secretion signal peptide"
MANKLLLLLLLLLLPLAASG

SEQ ID NO: 16 - DNA, 1599 bp, Saccharomyces cerevisiae
atgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtga

SEQ ID NO: 17 - protein, 512 aa, Saccharomyces cerevisiae
MTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 18 - DNA, 1092 bp, Prototheca moriformis
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgcc

SEQ ID NO: 19 - DNA, 1400 bp, Prototheca moriformis
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 20 - DNA, 4091 bp, Artificial Sequence
  source: /note="Description of Artificial Sequence: Synthetic polynucleotide"
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 21 - DNA, 510 bp, Artificial Sequence
  source: /note="Description of Artificial Sequence: Synthetic polynucleotide"
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 22 - DNA, 1186 bp, Artificial Sequence
  source: /note="Description of Artificial Sequence: Synthetic polynucleotide"
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 23 - DNA, 3615 bp, Artificial Sequence
  source: /note="Description of Artificial Sequence: Synthetic polynucleotide"
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 24 - DNA, 511 bp, Artificial Sequence
  source: /note="Description of Artificial Sequence: Synthetic polynucleotide"
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 25 - DNA, 761 bp, Artificial Sequence
  source: /note="Description of Artificial Sequence: Synthetic polynucleotide"
cagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 26 - DNA, 3599 bp, Artificial Sequence
  source: /note="Description of Artificial Sequence: Synthetic polynucleotide"
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggacagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 27 - DNA, 20 bp, Artificial Sequence
  source: /note="Description of Artificial Sequence: Synthetic primer"
tcacttcatgccggcggtcc

SEQ ID NO: 28 - DNA, 20 bp, Artificial Sequence
  source: /note="Description of Artificial Sequence: Synthetic primer"
gcgctcctgcttggctcgaa

SEQ ID NO: 29 - DNA, 2327 bp, Saccharomyces cerevisiae
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatgga

SEQ ID NO: 30 - DNA, 312 bp, Chlamydomonas reinhardtii
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaac

SEQ ID NO: 31 - DNA, 1599 bp, Saccharomyces cerevisiae; identical to SEQ ID NO: 16

SEQ ID NO: 32 - DNA, 408 bp, Chlorella vulgaris
gcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcc

SEQ ID NO: 33 - DNA, 733 bp, Artificial Sequence
  source: /note="Description of Artificial Sequence: Synthetic polynucleotide"
gctcttcgagacgtggtctgaatcctccaggcgggtttccccgagaaagaaagggtgccgatttcaaagcagagccatgtgccgggccctgtggcctgtgttggcgcctatgtagtcaccccccctcacccaattgtcgccagtttgcgcaatccataaactcaaaactgcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 34 - DNA, 739 bp, Artificial Sequence
  source: /note="Description of Artificial Sequence: Synthetic polynucleotide"
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagc

SEQ ID NO: 35 - DNA, 735 bp, Artificial Sequence
  source: /note="Description of Artificial Sequence: Synthetic polynucleotide"
gctcttcgaggggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 36 - DNA, 739 bp, Artificial Sequence; identical to SEQ ID NO: 34
  source: /note="Description of Artificial Sequence: Synthetic polynucleotide"

SEQ ID NO: 37 - DNA, 1065 bp, Prototheca moriformis
ggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcc

SEQ ID NO: 38 - DNA, 726 bp, Prototheca moriformis
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtacc

SEQ ID NO: 39 - DNA, 749 bp, Prototheca moriformis
gagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 40 - DNA, 595 bp, Artificial Sequence
  source: /note="Description of Artificial Sequence: Synthetic polynucleotide"
actagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 41 - DNA, 6101 bp, Artificial Sequence
  source: /note="Description of Artificial Sequence: Synthetic polynucleotide"
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 42 - DNA, 595 bp, Artificial Sequence; identical to SEQ ID NO: 40
  source: /note="Description of Artificial Sequence: Synthetic polynucleotide"

SEQ ID NO: 43 - DNA, 5348 bp, Artificial Sequence
  source: /note="Description of Artificial Sequence: Synthetic polynucleotide"
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 44 - DNA, 1220 bp, Artificial Sequence
  source: /note="Description of Artificial Sequence: Synthetic polynucleotide"
actagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 45 - DNA, 6726 bp, Artificial Sequence
  source: /note="Description of Artificial Sequence: Synthetic polynucleotide"
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 46 - DNA, 1220 bp, Artificial Sequence; identical to SEQ ID NO: 44
  source: /note="Description of Artificial Sequence: Synthetic polynucleotide"

SEQ ID NO: 47 - DNA, 5973 bp, Artificial Sequence
  source: /note="Description of Artificial Sequence: Synthetic polynucleotide"
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 48 - DNA, 612 bp, Artificial Sequence
  source: /note="Description of Artificial Sequence: Synthetic polynucleotide"
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtacc

SEQ ID NO: 49 - DNA, 528 bp, Artificial Sequence
  source: /note="Description of Artificial Sequence: Synthetic polynucleotide"
gacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 50 - DNA, 3499 bp, Artificial Sequence
  source: /note="Description of Artificial Sequence: Synthetic polynucleotide"
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctcactagtatcgatttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 51 - DNA, 6514 bp, Artificial Sequence
  source: /note="Description of Artificial Sequence: Synthetic polynucleotide"
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 52 - DNA, 1236 bp, Cuphea wrightii
atggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctga

SEQ ID NO: 53 - protein, 408 aa, Cuphea wrightii
MVVAAAASSAFFPVPAPRPTPKPGKFGNWPSSLSQPFKPKSNPNGRFQVKANVSPHPKANGSAVSLKSGSLNTLEDPPSSPPPRTFLNQLPDWSRLRTAITTVFVAAEKQFTRLDRKSKRPDMLVDWFGSETIVQDGLVFRERFSIRSYEIGADRTASIETLMNHLQDTSLNHCKSVGLLNDGFGRTPEMCTRDLIWVLTKMQIVVNRYPTWGDTVEINSWFSQSGKIGMGREWLISDCNTGEILVRATSAWAMMNQKTRRFSKLPCEVRQEIAPHFVDAPPVIEDNDRKLHKFDVKTGDSICKGLTPGWNDFDVNQHVSNVKYIGWILESMPTEVLETQELCSLTLEYRRECGRESVVESVTSMNPSKVGDRSQYQHLLRLEDGADIMKGRTEWRPKNAGTNRAIST

SEQ ID NO: 54 - DNA, 120 bp, Chlorella protothecoides
actagtatggccaccgcatccactttctcggcgttcaatgcccgctgcggcgacctgcgtcgctcggcgggctccgggccccggcgcccagcgaggcccctccccgtgcgcgggcgcgcc

SEQ ID NO: 55 - DNA, 1503 bp, Glycine max
atggccaccgcatccactttctcggcgttcaatgcccgctgcggcgacctgcgtcgctcggcgggctccgggccccggcgcccagcgaggcccctccccgtgcgcgggcgcgcctccacccactccggcaagaccatggccgtggccctgcagcccacccaggagatcaccaccatcaagaagccccccaccaagcagcgccgcgtggtggtgaccggcctgggcgtggtgacccccctgggccacgagcccgacatcttctacaacaacctgctggacggcgcctccggcatctccgagatcgagaccttcgactgcgccgagtaccccacccgcatcgccggcgagatcaagtccttctccaccgacggctgggtggcccccaagctgtccaagcgcatggacaagttcatgctgtacatgctgaccgccggcaagaaggccctggtggacggcggcatcaccgacgacgtgatggacgagctgaacaaggagaagtgcggcgtgctgatcggctccgccatgggcggcatgaaggtgttcaacgacgccatcgaggccctgcgcatctcctacaagaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacgtgatgctgtgcggcggctccgacgccgccatcatccccatcggcctgggcggcttcgtggcctgccgcgccctgtcccagcgcaacaccgaccccaccaaggcctcccgcccctgggacatcaaccgcgacggcttcgtgatgggcgagggcgccggcgtgctgctgctggaggagctggagcacgccaaggagcgcggcgccaccatctacgccgagttcctgggcggctccttcacctgcgacgcctaccacgtgaccgagccccgccccgacggcgccggcgtgatcctgtgcatcgagaaggccctggcccagtccggcgtgtccaaggaggacgtgaactacatcaacgcccacgccacctccacccccgccggcgacctgaaggagtaccaggccctgatgcactgcttcggccagaaccccgagctgcgcgtgaactccaccaagtccatgatcggccacctgctgggcgccgccggcggcgtggaggccgtggccaccatccaggccatccgcaccggctgggtgcaccccaacatcaacctggagaaccccgacaacggcgtggacgccaaggtgctggtgggctccaagaaggagcgcctggacgtgaaggccgccctgtccaactccttcggcttcggcggccacaactcctccatcatcttcgccccctacatggactacaaggaccacgacggcgactacaaggaccacgacatcgactacaaggacgacgacgacaagtga

SEQ ID NO: 56 - DNA, 1530 bp, Helianthus annuus
atggccaccgcatccactttctcggcgttcaatgcccgctgcggcgacctgcgtcgctcggcgggctccgggccccggcgcccagcgaggcccctccccgtgcgcgggcgcgcctgccgccgcggcggccgcgtggccatggccatcgccatccagccctcctccatcgagatggaggaggagaccaccctgaccaagcgcaagcagccccccaccaagcagcgccgcgtggtggtgaccggcatgggcgtggagacccccatcggcaacaaccccgaccagttctacaacaacctgctgcagggcgtgtccggcatcacccagatcgaggccttcgactgctcctcctaccccacccgcatcgccggcgagatcaagaacttctccaccgacggctgggtggcccccaagctgtccaagcgcatggaccgcttcatgctgtacatgctgaccgccggcaagaaggccctggccgacgccggcatctccccctccgactccgacgagatcgacaagtcccgctgcggcgtgctgatcggctccgccatgggcggcatgaaggtgttcaacgacgccatcgaggccctgcgcgtgtcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatgatgctgtgcggcggctccgacgccgtgatcatccccatcggcctgggcggcttcgtggcctgccgcgccctgtccgagcgcaacaccgaccccgccaaggcctcccgcccctgggactccggccgcgacggcttcgtgatgggcgagggcgccggcgtgctgctgctggaggagctggagcacgccaagaagcgcggcgccaagatctacgccgagttcctgggcggctccttcacctgcgacgcctaccacatgaccgagccccaccccgagggcgccggcgtgatcctgtgcatcgagaaggccctgtcccaggccggcgtgcgccgcgaggacgtgaactacatcaacgcccacgccacctccacccccgccggcgacctgaaggagtaccacgccctgctgcactgcttcggcaacaaccaggagctgcgcgtgaactccaccaagtccatgatcggccacctgctgggcgccgccggcgccgtggaggccgtggccaccgtgcaggccatccgcaccggctggatccaccccaacatcaacctggagaaccccgaccagggcgtggacaccaaggtgctggtgggctccaagaaggagcgcctgaacgtgaaggtgggcctgtccaactccttcggcttcggcggccacaactcctccatcctgttcgcccccttccagatggactacaaggaccacgacggcgactacaaggaccacgacatcgactacaaggacgacgacgacaagtga

SEQ ID NO: 57 - DNA, 1584 bp, Ricinus communis
atggccaccgcatccactttctcggcgttcaatgcccgctgcggcgacctgcgtcgctcggcgggctccgggccccggcgcccagcgaggcccctccccgtgcgcgggcgcgcctcccactactactcctccaacggcctgttccccaacacccccctgctgcccaagcgccacccccgcctgcaccaccgcctgccccgctccggcgaggccatggccgtggccgtgcagcccgagaaggaggtggccaccaacaagaagcccctgatgaagcagcgccgcgtggtggtgaccggcatgggcgtggtgtcccccctgggccacgacatcgacgtgtactacaacaacctgctggacggctcctccggcatctcccagatcgactccttcgactgcgcccagttccccacccgcatcgccggcgagatcaagtccttctccaccgacggctgggtggcccccaagctgtccaagcgcatggacaagttcatgctgtacatgctgaccgccggcaagaaggccctggccgacggcggcatcaccgaggacatgatggacgagctggacaaggcccgctgcggcgtgctgatcggctccgccatgggcggcatgaaggtgttcaacgacgccatcgaggccctgcgcatctcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatcatgctgtgcggcggctccgacgccgccatcatccccatcggcctgggcggcttcgtggcctgccgcgccctgtcccagcgcaacgacgaccccaccaaggcctcccgcccctgggacatgaaccgcgacggcttcgtgatgggcgagggcgccggcgtgctgctgctggaggagctggagcacgccaagaagcgcggcgccaacatctacgccgagttcctgggcggctccttcacctgcgacgcctaccacatgaccgagccccgccccgacggcgtgggcgtgatcctgtgcatcgagaaggccctggcccgctccggcgtgtccaaggaggaggtgaactacatcaacgcccacgccacctccacccccgccggcgacctgaaggagtacgaggccctgatgcgctgcttctcccagaaccccgacctgcgcgtgaactccaccaagtccatgatcggccacctgctgggcgccgccggcgccgtggaggccatcgccaccatccaggccatccgcaccggctgggtgcaccccaacatcaacctggagaaccccgaggagggcgtggacaccaaggtgctggtgggccccaagaaggagcgcctggacatcaaggtggccctgtccaactccttcggcttcggcggccacaactcctccatcatcttcgccccctacaagatggactacaaggaccacgacggcgactacaaggaccacgacatcgactacaaggacgacgacgacaagtga

SEQ ID NO: 58 - DNA, 7008 bp, Artificial Sequence
  source: /note="Description of Artificial Sequence: Synthetic polynucleotide"
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccgccgccgccgacgccaaccccgcccgccccgagcgccgcgtggtgatcaccggccagggcgtggtgacctccctgggccagaccatcgagcagttctactcctccctgctggagggcgtgtccggcatctcccagatccagaagttcgacaccaccggctacaccaccaccatcgccggcgagatcaagtccctgcagctggacccctacgtgcccaagcgctgggccaagcgcgtggacgacgtgatcaagtacgtgtacatcgccggcaagcaggccctggagtccgccggcctgcccatcgaggccgccggcctggccggcgccggcctggaccccgccctgtgcggcgtgctgatcggcaccgccatggccggcatgacctccttcgccgccggcgtggaggccctgacccgcggcggcgtgcgcaagatgaaccccttctgcatccccttctccatctccaacatgggcggcgccatgctggccatggacatcggcttcatgggccccaactactccatctccaccgcctgcgccaccggcaactactgcatcctgggcgccgccgaccacatccgccgcggcgacgccaacgtgatgctggccggcggcgccgacgccgccatcatcccctccggcatcggcggcttcatcgcctgcaaggccctgtccaagcgcaacgacgagcccgagcgcgcctcccgcccctgggacgccgaccgcgacggcttcgtgatgggcgagggcgccggcgtgctggtgctggaggagctggagcacgccaagcgccgcggcgccaccatcctggccgagctggtgggcggcgccgccacctccgacgcccaccacatgaccgagcccgacccccagggccgcggcgtgcgcctgtgcctggagcgcgccctggagcgcgcccgcctggcccccgagcgcgtgggctacgtgaacgcccacggcacctccacccccgccggcgacgtggccgagtaccgcgccatccgcgccgtgatcccccaggactccctgcgcatcaactccaccaagtccatgatcggccacctgctgggcggcgccggcgccgtggaggccgtggccgccatccaggccctgcgcaccggctggctgcaccccaacctgaacctggagaaccccgcccccggcgtggaccccgtggtgctggtgggcccccgcaaggagcgcgccgaggacctggacgtggtgctgtccaactccttcggcttcggcggccacaactcctgcgtgatcttccgcaagtacgacgagatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 59 - DNA, 1203 bp, Prototheca moriformis
atggcgtctgccgtcacctttgcgtgcgcccctccccgcggcgcggtcgccgcgccgggtcgccgcgctgcctcgcgtcccctggtggtgcacgccgtcgccagcgaggccccgctgggcgtgccgccctcggtgcagcgcccctcccccgtggtctactccaagctggacaagcaacaccgcctgacgcccgagcgcctggagctggtgcagagcatgggtcagttgcggaggagagggtgctccccgtgctgcaccccgtggacaagctgtggcagccgcaggacttcctggcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgcgaccaagtacagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggatctccggacgcgagattatggtctag

SEQ ID NO: 60 - protein, 400 aa, Prototheca moriformis
MASAVTFACAPPRGAVAAPGRRAASRPLVVHAVASEAPLGVPPSVQRPSPVVYSKLDKQHRLTPERLELVQSMGQLRRRGCSPCCTPWTSCGSRRTSWPDPESPDFEDQVAELRARAKDLPDEYFVVLVGDMITEEALPTYMAMLNTLDGVRDDTGAADHPWARWTRQWVAEENRHGDLLNKYCWLTGRVNMRAVEVTINNLIKSGMNPQTDNNPYLGFVYTSFQERATKYSHGNTARLAAEHGDKGLSKICGLIASDEGRHEIAYTRIVDEFFRLDPEGAVAAYANMMRKQITMPAHLMDDMGHGEANPGRNLFADFSAVAEKIDVYDAEDYCRILEHLNARWKVDERQVSGQAAADQEYVLGLPQRFRKLAEKTAAKRKRVARRPVAFSWISGREIMV

SEQ ID NO: 61 - DNA, 1203 bp, Prototheca moriformis
atggcgtctgccgtcacctttgcgtgcgcccctccccgcggcgcggtcgccgcgccgggtcgccgcgctgcctcgcgtcccctggtggtgcgcgcggtcgccagcgaggccccgctgggcgttccgccctcggtgcagcgcccctcccccgtggtctactccaagctggacaagcagcaccgcctgacgcccgagcgcctggagctggtgcagagcatggggcagtttgcggaggagagggtgctgcccgtgctgcaccccgtggacaagctgtggcagccgcaggactttttgcccgaccccgagtcgcccgacttcgaggatcaggtggcggagctgcgcgcgcgcgccaaggacctgcccgacgagtactttgtggtgctggtgggggacatgatcacggaggaggcgctgccgacctacatggccatgctcaacacgctggacggcgtgcgcgacgacacgggcgcggccgaccacccgtgggcgcgctggacgcggcagtgggtggccgaggagaaccggcacggcgacctgctgaacaagtactgctggctgacggggcgcgtcaacatgcgggccgtggaggtgaccatcaacaacctgatcaagagcggcatgaacccgcagacggacaacaacccttatttggggttcgtctacacctccttccaggagcgcgccaccaagtacagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggatctccgggcgcgagatcatggtctag

SEQ ID NO: 62 - protein, 400 aa, Prototheca moriformis
MASAVTFACAPPRGAVAAPGRRAASRPLVVRAVASEAPLGVPPSVQRPSPVVYSKLDKQHRLTPERLELVQSMGQFAEERVLPVLHPVDKLWQPQDFLPDPESPDFEDQVAELRARAKDLPDEYFVVLVGDMITEEALPTYMAMLNTLDGVRDDTGAADHPWARWTRQWVAEENRHGDLLNKYCWLTGRVNMRAVEVTINNLIKSGMNPQTDNNPYLGFVYTSFQERATKYSHGNTARLAAEHGDKNLSKICGLIASDEGRHEIAYTRIVDEFFRLDPEGAVAAYANMMRKQITMPAHLMDDMGHGEANPGRNLFADFSAVAEKIDVYDAEDYCRILEHLNARWKVDERQVSGQAAADQEYVLGLPQRFRKLAEKTAAKRKRVARRPVAFSWISGREIMV

SEQ ID NO: 63 - DNA, 363 bp, Prototheca moriformis
  modified_base (300)..(300): a, c, t, g, unknown or other
atggcgttcttgcagcggacgagcgcgctggtgcgccagggtgtcctgtctcgcctcgccgtgcaggccagccccgccctgaacagcgtccgggccttcgcctcggcgtcctacctggacaagaatgaggtgacgcaccgcgtgctgtcgattgtcaagaactttgaccgcgtcgacgccggcaaggtcacggactctgccaacttccagtccgacctgggtctggactcactagacaccgtggagctggtcatggccctggaggaggagtttgcgatcgagatcccggatgcggaggcngacaagatcctctccgtcccggaggcgatttcctacattgccgcgaaccccatggccaagtag

SEQ ID NO: 64 - DNA, 363 bp, Prototheca moriformis; identical to SEQ ID NO: 63
  modified_base (300)..(300): a, c, t, g, unknown or other

SEQ ID NO: 65 - protein, 120 aa, Prototheca moriformis
MAFLQRTSALVRQGVLSRLAVQASPALNSVRAFASASYLDKKEVTDRVLSIVKNFDRVDAGKVTDSANFQSDLGLDSLDTVELVMALEEEFAIEIPDAEADKILSVPEAISYIAANPMAK

SEQ ID NO: 66 - DNA, 1071 bp, Prototheca moriformis
atggttgcggctcaggaagacggctccatggagaggaggacctcggccaacccctccgtgggtcttagcagcttaaagcacgttccgctgagtgcggtggacctcccgaatttcgagtccgctcccaagggtgcggccagccccgatgtccatcgtcagatagaggaactggtggataaggcacgcgcagatcggtcaccggcctcgttgtcgctcctagccgatgtgctggacatcagcgggccgctgcaggacgcggcctcggcgatggtggacgactccttcctgcgctgcttcacctccaccatggacgagccctggaactggaacttttacctgttcccgctctgggcgctcggcgtcgtcgtccgcaacctgatcctgttccccctgcgcctcctcaccatcgtgctggggacgctgctcttcgtgctggcctttgccgtgacgggctttctccccaaggagaagcggctcgcggccgagcagcggtgcgtccagttcatggcgcaggcgttcgtggcctcctggacaggcgtgatccggtaccacggcccccgccccgtggcggcgcccaaccgcgtgtgggtcgccaaccacacgtccatgatcgactacgcggtgctgtgcgcctactgcccgtttgcggccatcatgcagctgcaccccggctgggtgggcgtcttccagacgcgctacctggcctcgctgggctgcctctggttcaaccgcacgcaggccaaggaccgcacgctcgtggccaagcgcatgcgcgagcacgtggccagcgcgaccagcacgccgctgctcatcttccccgagggcacctgcgtcaacaacgagtactgcgtcatgttccgcaagggcgcctttgacctgggcgccaccgtctgccccgtggccatcaagtacaacaagatcttcgtcgacgccttttggaacagcaagcgccagtccttctccgcgcacctcatgaagatcatgcgctcgtgggccctcgtctgcgacgtctacttcctggagccccagacgcggagggagggcgagtcggtcgaggcgtttgcgaaccgc

SEQ ID NO: 67 - DNA, 1401 bp, Prototheca moriformis
atggtcgcgaccctgtccctcgccggccccgcctgcaacacgcagtgcgtatccagcaagcgggttgtcgccttcaaccgcccccatgttggcgtccgggctcgatcagccgtggtcgcccgagctgcgaagcgggaccccacccagcgcattgtgatcaccggaatgggcgtggcctccgtgtttggcaacgatgtcgagaccttttacgacaagcttctggaaggaacgagcggcgtggacctgatttccaggtttgacatctccgagttcccgaccaagtttgcggcgcagatcaccggcttctccgtggaggactgcgtggacaagaagaacgcgcggcggtacgacgacgcgctgtcgtacgcgatggtggcctccaagaaggccctgcgccaggcaggcctggagaaggacaagtgccccgagggctacggggcgctggacaagacgcgcacgggcgtgctggtcggctcgggcatgggcgggctgacggtcttccaggacggcgtcaaggcgctggtggagaagggctacaagaagatgagccccttcttcatcccctacgccatcaccaacatgggctccgcgctggtgggcatcgaccagggcttcatgggccccaactactccgtctccacagcctgcgcgacgtccaactacgcatttgtgaacgcggccaaccacatccgcaagggcgacgcggacgtcatggtcgtcggcggcaccgaggcctccatcgtgcccgtgggcctgggcggctttgtggcctgccgcgcgctgtccacgcgcaacgacgagcccaagcgcgcgagccggccgtgggacgagggccgcgacggctttgtgatgggcgagggcgcggccgtgctggtcatggagtcgctggagcacgcgcagaagcgtggcgcgaccatcctgggcgagtacctgggcggcgccatgacctgcgacgcgcaccacatgacggacccgcaccccgagggcctgggcgtgagcacctgcatccgcctggcgctcgaggacgccggcgtctcgcccgacgaggtcaactacgtcaacgcgcacgccacctccaccctggtgggcgacaaggccgaggtgcgcgcggtcaagtcggtctttggcgacatgaagggtatcaagatgaacgccaccaagagtatgatcgggcactgcctgggcgccgccggcggcatggaggccgtcgcgacgctcatggccatccgcaccggctgggtgcaccccaccatcaaccacgacaaccccatcgccgaggtcgatggcctggacgtcgtcgccaacgccaaggcccagcacgacatcaacgtcgccatctccaactccttcggctttggcgggcacaactccgtcgtcgcctttgcgcccttccgcgagtag

SEQ ID NO: 68 - protein, 466 aa, Prototheca moriformis
MVATLSLAGPACNTQCVSSKRVVAFNRPHVGVRARSAVVARAAKRDPTQRIVITGMGVASVFGNDVETFYDKLLEGTSGVDLISRFDISEFPTKFAAQITGFSVEDCVDKKNARRYDDALSYAMVASKKALRQAGLEKDKCPEGYGALDKTRTGVLVGSGMGGLTVFQDGVKALVEKGYKKMSPFFIPYAITNMGSALVGIDQGFMGPNYSVSTACATSNYAFVNAANHIRKGDADVMVVGGTEASIVPVGLGGFVACRALSTRNDEPKRASRPWDEGRDGFVMGEGAAVLVMESLEHAQKRGATILGEYLGGAMTCDAHHMTDPHPEGLGVSTCIRLALEDAGVSPDEVNYVNAHATSTLVGDKAEVRAVKSVFGDMKGIKMNATKSMIGHCLGAAGGMEAVATLMAIRTGWVHPTINHDNPIAEVDGLDVVANAKAQHDINVAISNSFGFGGHNSVVAFAPFRE

SEQ ID NO: 69 - DNA, 1401 bp, Prototheca moriformis
atggtcgcgaccctctccctcgccggccccgcctgcaacacgcagtgcgtatccggcaagcgggctgtcgccttcaaccgcccccatgttggcgtccgggctcgatcagccgtggtcgcccgggctgcgaagcgggaccccacccagcgcattgtgatcaccggaatgggcgtggcctccgtgtttggcaacgatgtcgagaccttttacaacaagcttctggaaggaacgagcggcgtggacctgatttccaggtttgacatctccgagttcccgaccaagtttgcggcgcagatcaccggcttctccgtggaggactgcgtggacaagaagaacgcgcggcggtacgacgacgcgctgtcgtacgcgatggtggcctccaagaaggccctgcgccaggcgggactggagaaggacaagtgccccgagggctacggagcgctggataagacgcgcgcgggcgtgctggtcggctcgggcatgggcgggctgacggtcttccaggacggcgtcaaggcgctggtggagaagggctacaagaagatgagccccttcttcatcccctacgccatcaccaacatgggctccgcgctggtgggcatcgaccagggcttcatggggcccaactactccgtctccacggcctgcgcgacctccaactacgcctttgtgaacgcggccaaccacatccgcaagggcgacgcggacgtcatggtcgtgggcggcaccgaggcctccatcgtgcccgtgggcctgggcggctttgtggcctgccgcgcgctgtccacgcgcaacgacgagcccaagcgcgcgagccggccgtgggacgagggccgcgacggcttcgtgatgggcgagggcgcggccgtgctggtcatggagtcgctggagcacgcgcagaagcgcggcgcgaccatcctgggcgagtacctggggggcgccatgacctgcgacgcgcaccacatgacggacccgcaccccgagggcctgggcgtgagcacctgcatccgcctggcgctcgaggacgccggcgtctcgcccgacgaggtcaactacgtcaacgcgcacgccacctccaccctggtgggcgacaaggccgaggtgcgcgcggtcaagtcggtctttggcgacatgaagggcatcaagatgaacgccaccaagtccatgatcgggcactgcctgggcgccgccggcggcatggaggccgtcgccacgctcatggccatccgcaccggctgggtgcaccccaccatcaaccacgacaaccccatcgccgaggtcgacggcctggacgtcgtcgccaacgccaaggcccagcacaaaatcaacgtcgccatctccaactccttcggcttcggcgggcacaactccgtcgtcgcctttgcgcccttccgcgagtag

SEQ ID NO: 70 - protein, 466 aa, Prototheca moriformis
MVATLSLAGPACNTQCVSGKRAVAFNRPHVGVRARSAVVARAAKRDPTQRIVITGMGVASVFGNDVETFYNKLLEGTSGVDLISRFDISEFPTKFAAQITGFSVEDCVDKKNARRYDDALSYAMVASKKALRQAGLEKDKCPEGYGALDKTRAGVLVGSGMGGLTVFQDGVKALVEKGYKKMSPFFIPYAITNMGSALVGIDQGFMGPNYSVSTACATSNYAFVNAANHIRKGDADVMVVGGTEASIVPVGLGGFVACRALSTRNDEPKRASRPWDEGRDGFVMGEGAAVLVMESLEHAQKRGATILGEYLGGAMTCDAHHMTDPHPEGLGVSTCIRLALEDAGVSPDEVNYVNAHATSTLVGDKAEVRAVKSVFGDMKGIKMNATKSMIGHCLGAAGGMEAVATLMAIRTGWVHPTINHDNPIAEVDGLDVVANAKAQHKINVAISNSFGFGGHNSVVAFAPFRE

SEQ ID NO: 71 - DNA, 1104 bp, Prototheca moriformis
atggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccgcattcggggcaacgaggtgggcccctcgcagcggctgacgatcacggcggtggccaacatcctgcaggaggcggcgggcaaccacgcggtggccatgtggggccggagctcggagggtttcgcgacggacccggagctgcaggaggcgggtctcatctttgtgatgacgcgcatgcagatccagatgtaccgctacccgcgctggggcgacctgatgcaggtggagacctggttccagacggcgggcaagctgggcgcgcagcgcgagtgggtgctgcgcgacaagctgaccggcgaggcgctgggcgcggccacctcgagctgggtcatgatcaacatccgcacgcgccggccgtgccgcatgccggagctcgtccgcgtcaagtcggccttcttcgcgcgcgagccgccgcgcctggcgctgccgcccgcggtcacgcgtgccaagctgcccaacatcgcgacgccggcgccgctgcgcgggcaccgccaggtcgcgcgccgcaccgacatggacatgaacgggcacgtgaacaacgtggcctacctggcctggtgcctggaggccgtgcccgagcacgtcttcagcgactaccacctctaccagatggagatcgacttcaaggccgagtgccacgcgggcgacgtcatctcctcccaggccgagcagatcccgccccaggaggcgctcacgcacaacggcgccggccgcaacccctcctgcttcgtccatagcattctgcgcgccgagaccgagctcgtccgcgcgcgaaccacatggtcggcccccatcgacgcgcccgccgccaagccgcccaaggcgagccactga

SEQ ID NO: 72 - protein, 367 aa, Prototheca moriformis
MAPTSLLASTGVSSASLWSSARSSACAFPVDHAVRGAPQRPLPMQRRCFRTVAVRAAPAVAVRPEPAQEFWEQLEPCKMAEDKRIFLEEHRIRGNEVGPSQRLTITAVANILQEAAGNHAVAMWGRSSEGFATDPELQEAGLIFVMTRMQIQMYRYPRWGDLMQVETWFQTAGKLGAQREWVLRDKLTGEALGAATSSWVMINIRTRRPCRMPELVRVKSAFFAREPPRLALPPAVTRAKLPNIATPAPLRGHRQVARRTDMDMNGHVNNVAYLAWCLEAVPEHVFSDYHLYQMEIDFKAECHAGDVISSQAEQIPPQEALTHNGAGRNPSCFVHSILRAETELVRARTTWSAPIDAPAAKPPKASH

SEQ ID NO: 73 - DNA, 1144 bp, Prototheca moriformis
atggtcgctgcgggcgacgtcgctggagccaccgcctctgagggagatggccgggccctggccaacccgccgcccttcacgctggccgacatccgcaacgccattcccaaggactgcttccgcaagagcgcggccaagtcgttggcgtacctgggtctggacctttccatcgtcacgggcatggctgtgctggcctacaaaatcaactcgccgtggctctggcccctgtactggtttgcccagggaacgatgttttgggccctgtttgtcgtcggccacgactgtggccaccagagctttagcacgagcaagcggctgaacgacgcggtcggtcttttcgtacactccatcatcggcgtgccgtaccacggctggcgcatctcccaccgcacccaccacaacaaccacggccacgtggagaacgacgagtcctggtacccgcccaccgagagcgggctcaaggcgatgaccgacatgggccggcaggggcgcttccactttcccaccatgctctttgtctaccccttttacctcttctggcggtccccgggcaagaccgggtcccactttagcccctccaccgacctcttcgcctcgtgggaggcccccctgatccggacgtcaaacgcgtgccagctggcgtggctgggcgcgctggcggcggggacctgggcgctgggcgtgctgcccatgctcaacctgtacctcgcgccctacgtgatatcggtggcgtggctggatctggtgacgtacctgcaccaccacggcccctcggacccgcgcgaggagatgccctggtaccgcggccgcgagtggagctacatgcgcggcgggctgaccaccatcgaccgcgactacggcctcttcaacaaggtccaccacgacattgggacgcacgtcgtgcaccacctgttcccgcagatcccgcactacaacctctgccgcgccacggaggccgccaagaaggtgctggggccctactaccgcgagcccgagcgctgcccgctgggcctgctgcccgtgcacctgctcgcgcccctgctccgctccctcggccaggaccactttgtcgacgacgcgggctccgtcctcttctaccgccgcgccgagggcatcaacccctggatccagaagctcctgccct

SEQ ID NO: 74 - protein, 381 aa, Prototheca moriformis
MVAAGDVAGATASEGDGRALANPPPFTLADIRNAIPKDCFRKSAAKSLAYLGLDLSIVTGMAVLAYKINSPWLWPLYWFAQGTMFWALFVVGHDCGHQSFSTSKRLNDAVGLFVHSIIGVPYHGWRISHRTHHNNHGHVENDESWYPPTESGLKAMTDMGRQGRFHFPTMLFVYPFYLFWRSPGKTGSHFSPSTDLFASWEAPLIRTSNACQLAWLGALAAGTWALGVLPMLNLYLAPYVISVAWLDLVTYLHHHGPSDPREEMPWYRGREWSYMRGGLTTIDRDYGLFNKVHHDIGTHVVHHLFPQIPHYNLCRATEAAKKVLGPYYREPERCPLGLLPVHLLAPLLRSLGQDHFVDDAGSVLFYRRAEGINPWIQKLLP

SEQ ID NO: 75 - DNA, 1132 bp, Prototheca moriformis
atggtcgctgcgggcgacgtcgctagagccaccgcctctgagggagatggccgggccctggccaacccgccgcccttcacgctggccgacatccgcaacgccattcccaaggactgcttccgcaagagcgcggctaagtcgttggcgtacctgggtttggacctctccatcatcacgggcatggctgtgctggcctacaaaatcaactcgccgtggctctggcccctgtactggtttgcccagggaacgatgttttgggccctgtttgtcgtcggacacgactgtggccaccagagctttagcacgagcaagcggctgaacgacgcggtcggtctttttgtgcactccatcatcggcgtgccgtaccacggctggcgcatctcccaccgcacccaccacaacaaccacggccacgtggagaacgacgagtcctgcgaaagcgggctcaaggcgatgaccgatatgggccggcagggccgattccactttccctccatgctctttgtctaccccttttacctcttctggcggtccccgggcaagaccgggtcccactttagccccgccacagacctcttcgccttgtgggaggcccccctgatccggacgtccaacgcgtgccagctggcgtggctgggcgcgctggcggcggggacctgggcgctgggcgtgctgccgatgctgaacctgtacctcgcgccctacgtgatctcggtggcctggctggacctggtgacgtacctgcaccaccacggcccctcggacccgcgcgaggagatgccctggtaccgcggccgggagtggagctacatgcgcggcgggctgaccacaatcgaccgcgactacggtcttttcaacaaggtccaccacgacatcgggacgcacgtcgtgcaccacctgttcccgcagatcccgcactacaacctctgccgcgccacgaaggccgccaagaaggtgctggggccctactaccgcgagcccgagcgctgcccgctgggcctgctgcccgtgcacctgctcgcgcccctgctccgctccctcggccaggaccactttgtcgacgacgcgggctccgtcctcttctaccggcgcgccgagggcatcaacccctggatccagaagctcctgccct

SEQ ID NO: 76 - protein, 377 aa, Prototheca moriformis
MVAAGDVARATASEGDGRALANPPPFTLADIRNAIPKDCFRKSAAKSLAYLGLDLSIITGMAVLAYKINSPWLWPLYWFAQGTMFWALFVVGHDCGHQSFSTSKRLNDAVGLFVHSIIGVPYHGWRISHRTHHNNHGHVENDESCESGLKAMTDMGRQGRFHFPSMLFVYPFYLFWRSPGKTGSHFSPATDLFALWEAPLIRTSNACQLAWLGALAAGTWALGVLPMLNLYLAPYVISVAWLDLVTYLHHHGPSDPREEMPWYRGREWSYMRGGLTTIDRDYGLFNKVHHDIGTHVVHHLFPQIPHYNLCRATKAAKKVLGPYYREPERCPLGLLPVHLLAPLLRSLGQDHFVDDAGSVLFYRRAEGINPWIQKLLP

SEQ ID NO: 77 - protein, 368 aa, Prototheca moriformis
MAIKTNRQPVEKPPFTIGTLRKAIPAHCFERSALRSSMYLAFDIAVMSLLYVASTYIDPAPVPTWVKYGIMWPLYWFFQGAFGTGVWVCAHECGHQAFSSSQAINDGVGLVFHSLLLVPYYSWKHSHRRHHSNTGCLDKDEVFVPPHRAVAHEGLEWEEWLPIRMGKVLVTLTLGWPLYLMFNVASRPYPRFANHFDPWSPIFSKRERIEVVISDLALVAVLSGLSVLGRTMGWAWLVKTYVVPYMIVNMWLVLITLLQHTHPALPHYFEKDWDWLRGAMATVDRSMGPPFMDSILHHISDTHVLHHLFSTIPHYHAEEASAAIRPILGKYYQSDSRWVGRALWEDWRDCRYVVPDAPEDDSALWFHK

SEQ ID NO: 78 - DNA, 1107 bp, Prototheca moriformis
atggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccagggcgccttcggcacgggtgtctgggtgtgcgcgcacgagtgcggtcaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgtgcggtggcgcacgagggcctggagtgggaggagtggctgcccatccgcatgggcaaggtgctggtcaccttgaccctgggctggccgctgtacctcatgttcaacgtcgcctcccgcccttacccgcgcttcgccaaccactttgacccgtggtcgcccatcttcagcaagcgcgagcgcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtga

SEQ ID NO: 79 - DNA, 1214 bp, Prototheca moriformis
atggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtga

SEQ ID NO: 80 - protein, 368 aa, Prototheca moriformis
  MOD_RES (218)..(218): Any amino acid
MAIKTNRQPVEKPPFTIGTLRKAIPAHCFERSALRSSMYLAFDIAVMSLLYVASTYIDPAPVPTWVKYGVMWPLYWFFQGAFGTGVWVCAHECGHQAFSSSQAINDGVGLVFHSLLLVPYYSWKHSHRRHHSNTGCLDKDEVFVPPHRAVAHEGLEWEEWLPIRMGKVLVTLTLGWPLYLMFNVASRPYPRFANHFDPWSPIFSKRERIEVVISDLAXVAVLSGLSVLGRTMGWAWLVKTYVVPYLIVNMWLVLITLLQHTHPALPHYFEKDWDWLRGAMATVDRSMGPPFMDNILHHISDTHVLHHLFSTIPHYHAEEASAAIRPILGKYYQSDSRWVGRALWEDWRDCRYVVPDAPEDDSALWFHK

SEQ ID NO: 81 - DNA, 1071 bp, Prototheca moriformis; identical to SEQ ID NO: 66

SEQ ID NO: 82 - protein, 357 aa, Prototheca moriformis
MVAAQEDGSMERRTSANPSVGLSSLKHVPLSAVDLPNFESAPKGAASPDVHRQIEELVDKARADRSPASLSLLADVLDISGPLQDAASAMVDDSFLRCFTSTMDEPWNWNFYLFPLWALGVVVRNLILFPLRLLTIVLGTLLFVLAFAVTGFLPKEKRLAAEQRCVQFMAQAFVASWTGVIRYHGPRPVAAPNRVWVANHTSMIDYAVLCAYCPFAAIMQLHPGWVGVFQTRYLASLGCLWFNRTQAKDRTLVAKRMREHVASATSTPLLIFPEGTCVNNEYCVMFRKGAFDLGATVCPVAIKYNKIFVDAFWNSKRQSFSAHLMKIMRSWALVCDVYFLEPQTRREGESVEAFANR

SEQ ID NO: 83 - protein, 294 aa, Prototheca moriformis
MPPPEAPTNGDLAAPFVRKDRFGEYGMAPQPPMVKVVLALEALVLLPLRAVSVFILVVLYWLICNASVALPPKYCAAVTVTAGRLVCRWALFCFGFHYIKWVNLAGAEEGPRPGGIVSNHCSYLDILLHMSDSFPAFVARQSTAKLPFIGIISQIMSCLYVNRDRSGPNHVGVADLVKQRMQDEAEGKTPPEYRPLLLFPEGTTSNGDYLLPFKTGAFLAGVPVQPVVLHYHRLPVYVPNEEEKADPKLYAQNVRKAMMEVAGTKDTTAVFEDKMRYLNSLKRKYGKPVPKKIE

SEQ ID NO: 84 - DNA, 1008 bp, Prototheca moriformis
aaattattggcctcatccgcgagggtcggagcctttcaaacgtcacaagctgtatatttgagtccctctcaattcgtttgaaatgaaggagcaagtggttaatgcccccccctgaggcccccacgaatggggaccttgcggccccctttgtgcggaaggaccggttcggggagtatggcatggccccgcagcccccgatggtgaaggtggtgttggcactcgaggccttggtgctcttgccgctgcgcgcggtgagcgtgttcatcctcgtcgtgctatactggctcatttgcaatgcttcggtcgcactcccgcccaagtactgcgcggccgtcacggtcaccgctgggcgcttggtctgccggtgggcgctcttctgcttcggattccactacatcaagtgggtgaacctggcgggcgcggaggagggcccccgcccgggcggcattgttagcaaccactgcagctacctggacatcctgctgcacatgtccgattccttccccgcctttgtggcgcgccagtcgacggccaagctgccctttatcggcatcatcagccaaattatgagctgcctctacgtgaaccgcgaccgctcggggcccaaccacgtgggtgtggccgacctggtgaagcagcgcatgcaggacgaggccgaggggaagaccccgcccgagtaccggccgctgctcctcttccccgagggcaccacctccaacggcgactacctgcttcccttcaagaccggcgccttcctggccggggtgcccgtccagcccgtcgtcctccactaccacaggttgcccgtgtacgtccccaatgaggaggaaaaggccgaccccaagctgtacgcccaaaacgtccgcaaagccatgatggaggtcgccgggaccaaggacacgacggcggtgtttgaggacaagatgcgctacctgaactccctgaagagaaagtacggcaagcctgtgcctaagaaaattgagtgaacccccgtcgtcgaccaaagag

SEQ ID NO: 85 - protein, 395 aa, Prototheca moriformis
MASAAFTMSACPAMTGRAPEARRSGRPVATRLRAVAAPPRSQGLTPTIVRQDVLHSATDLQIEVIKDLTPVFESKILPLLPGVDDLWQPTDYLPASNSERFFDEIGELRERSASLSDELLVCLVGDMITEEALPTYMAMINTLDGMRDETGRDAHPYARWTRSWVAEENRHGDLLNKYLWLTGRVDMLAVERTIQRLISTGMDPGTENHPYHGFVFTSFQERATKLSHGATARIAHAAGDEALAKICGTIARDESRHEMAYTRTMEAIFERDPSGAVVAFAHMMLRKITMPAHLMDDGRHERATGRSLFDDYAAVAERIGVYTAKDYISILKHLIKRWKVEGLTGLTPEARQAQDLLCSLPTRFERLARHKSKKVTDTPPAQVQFSWVFQRPVAM

SEQ ID NO: 86 - DNA, 1514 bp, Prototheca moriformis
atggcttccgcggcattcaccatgtcggcgtgccccgcgatgactggcagggcccctgaggcacgtcgctccggacggccagtcgccacccgcctgagggctgtggcggccccgccgcgttcccagggcctcacccccaccatcgtccgccaagatgtgtgctgcactctgccacggacctgcagatcgaggtgatcaaggacctgacccccgtgtttgagtccaagatcctgcccctgctgcccggcgtggacgacctgtggcagccgacggactaccttcccgcctccaactcggagcgtttcttcgacgagatcggggagctgcgcgagcgctcggcgtcgctgtcggacgagcttctggtgtgcctggtgggcgacatgatcacggaggaggcgctgccgacctacatggccatgatcaacacgctggacgggatgcgggacgagacggggcgcgacgcgcacccgtacgcgcgctggacgcgcagctgggtggcggaggagaaccgccacggcgacctgctgaacaagtacctctggctgacggggcgcgtggacatgctggccgtggagcgcacgatccagcgcctcatctccacgggcatggacccgggcacggagaaccacccctaccacggcttcgtcttcacctccttccaggagcgcgcgaccaagctgagccacggcgccaccgcgcgcatcgcgcacgccgccggcgacgaggcgctggccaagatctgcggcaccatcgcgcgcgacgagtcgcgccacgagatggcctacacgcgcacgatggaggccatcttcgagcgcgacccctcgggcgcggtcgtcgcctttgcgcacatgatgctgcgcaagatcaccatgcccgcgcacctcatggacgacggccgccacgagcgcgccacgggacgctcgctcttcgacgactacgcggccgtcgccgagcgcatcggcgtctacaccgccaaggactacatctccatcctcaagcacctcatcaagcgctggaaggtggagggcctgaccgggctgaccccggaggcgcgccaggcgcaggacctgctctgctccctccccacccgcttcgagcgcctggccaggcacaagtccaagaaggtgaccgacacgcccccggcccaggtccagttctcctgggtcttccagaggcccgtcgccatgtaaagagattggcgcctgattcggtttggatccgaggatttccaatcggtgagagggactgggtgcccaactaccgcccttgcaccatcgcccttgcactatttattcccactttctgctcgccctgccgggcgattgcgggcgtttctgcccttgacgtattaatttcgcccctgctggcgcgagggttcttcaagttgataagaacgcactcccgccagctctgtactttttctgcggggcccctgcatggcttgttccctatgcttgctcgatcgacggcgcccattgcccacggcgtcgccgcatccatgtgaagaaacacgg

SEQ ID NO: 87 - DNA, 1520 bp, Prototheca moriformis
atggcttccgcggcattcaccatgtcggcgtgccccgcgatgactggcagggcccctggggcacgtcgctccggacggccagtcgccacccgcctgagggctgtggcggccccgccgcgttcccagggcctcacccccaccatcgtccgccaagatgtgtgctgcactctgccacggacctgcagatcgaggtgatcaaggacctgacccccgtgtttgagtccaagatcctgcccctgctgcccggcgtggacgacctgtggcagccgacggactacctgcccgcctccaactcggagcgcttcttcgacgagatcggggagctgcgcgagcgctcggcggcgctgtcggacgagctgctggtgtgcctggtcggcgacatgatcacggaggaggcgctgccgacctacatggccatgatcaacacgctggacgggatgcgggacgagacggggcgcgacgcgcacccgtacgcgcgctggacacgcagctgggtggcggaggagaaccgccacggcgacctgctgaacaagtacctctggctgacggggcgcgtggacatgctggccgtggagcgcaccatccagcgcctcatctccacgggcatggacccgggcacggagaaccacccctaccacggcttcgtcttcacctccttccaggagcgcgcgaccaagctgagccacggcgccaccgcgcgcatcgcgcacgccgccggcgacgaggccctggccaagatctgcggcaccatcgcgcgcgacgagtcacgccacgagatggcctacacgcgcacgatggaggccatcttcgagcgcgacccctcgggcgcggtcgtcgcctttgcgcacatgatgctgcgcaagatcaccatgcccgcgcacctcatggacgacgggcggcacgagcgcgccacggggcgctcgctcttcgacgactacgcggccgtggccgagcgcatcggcgtctacaccgccaaggactacatctccatcctcaagcacctcatcaagcgctggaaggtggagggcctgaccgggctgaccccggaggcgcgccaggcccaggacctgctctgctccctccccgcccgctttgagcgcctggccaagcacaagtccaagaaggtgaccgacacgcccccggcccaggtccagttctcctgggtcttccagaggcccgtcgccatgtaaagtggcagagattggcgcctgattcgatttggatccaaggatctccaatcggtgatggggactgagtgcccaactaccacccttgcactatcgtcctcgcactatttattcccaccttctgctcgccctgccgggcgattgcgggcgtttctgcccttgacgtatcaatttcgcccctgctggcgcgaggattcttcattctaataagaactcactcccgccagctctgtacttttcctgcggggcccctgcatggcttgttcccaatgcttgctcgatcgacggcgcccattgcccacggcgctgccgcatccatgtgaagaaacacgg

SEQ ID NO: 88 - protein, 395 aa, Prototheca moriformis
MASAAFTMSACPAMTGRAPGARRSGRPVATRLRAVAAPPRSQGLTPTIVRQDVLHSATDLQIEVIKDLTPVFESKILPLLPGVDDLWQPTDYLPASNSERFFDEIGELRERSAALSDELLVCLVGDMITEEALPTYMAMINTLDGMRDETGRDAHPYARWTRSWVAEENRHGDLLNKYLWLTGRVDMLAVERTIQRLISTGMDPGTENHPYHGFVFTSFQERATKLSHGATARIAHAAGDEALAKICGTIARDESRHEMAYTRTMEAIFERDPSGAVVAFAHMMLRKITMPAHLMDDGRHERATGRSLFDDYAAVAERIGVYTAKDYISILKHLIKRWKVEGLTGLTPEARQAQDLLCSLPARFERLAKHKSKKVTDTPPAQVQFSWVFQRPVAM

SEQ ID NO: 89 - protein, 119 aa, Prototheca moriformis
MAMSMTSCRAVCAPRATLRVQAPRVAVRPFRAQRMICRAVDKASVLSDVRVIIAEQLGTDVEKVNADAKFADLGADSLDTVEIMMALEEKFDLQLDEEGAEKITTVQEAADLISAQIGA

SEQ ID NO: 90 - protein, 119 aa, Prototheca moriformis
  MOD_RES (83)..(83): Any amino acid
  MOD_RES (117)..(117): Any amino acid
MAMSMTSCRAVCAPRATLRVQAPRVAVRPFRAQRMICRAVDKASVLSDVRVIIAEQLGTDVEKVNADAKFADLGADSLDTVEXMMALEEKFDLQLDEEGAEKITTVQEAADLISAQXGA

SEQ ID NO: 91 - DNA, 933 bp, Prototheca moriformis
atgctgctctcgcgcttcaaccccatcagcgagaaggccaccaacgccacggtgctcgactttgagaaacctttggtggaacttgatcataaaattcgcgaggtccgcaaagtcgcggaggagaacggcgtggacgtcacggagcagatccgcgagctggaggaccgcgcgcagcaggtagtcgagtctgtgtggagagggttgcgaaaggagacgtactccaagctgacgccgatccagcggctgcaggtggcgcgccaccccaaccgccccactttcttggacattgcgctcaacatcacggacaagtttgtggagctgcacggcgatcgcgcggggtacgacgacccggcgctcgtctgcggcatcgcgtcgatcgacaacgtgagcttcatgttcatgggccaccagaagggccgcaacaccaaggagaacatctaccgcaatttcggcatgccgcagcccaacggctaccgcaaggcgctgcgcttcatgcgcctggcggacaagtttggcttccccatcgtcacgtttgtggacacgcccggcgcgtacgcggggctcaaggccgaggagctgggccagggcgaggccatcgcggtcaacctgcgcgagatgtttggcttccgcgtgcccatcatctccatcgtcatcggcgagggcggctccggcggcgcgctggccatcggctgcgccaaccgcatgctcatcatggagaacgcggtgtactacgtggcctctcccgaggcctgcgcggccatcctgtggaagagccgcgacaaggcgggcctggccaccgaggcgctcaagatcacgcccgccgacctggtcaagctcaaggtcatggacgagatcgtgccggagccgctgggcgccgcgcacaccgaccccatgggcgccttcccggccgtgcgcgaggccatcctgcgccac

SEQ ID NO: 92 - DNA, 1824 bp, Prototheca moriformis
  modified_base (505)..(514): a, c, t, g, unknown or other
  modified_base (968)..(977): a, c, t, g, unknown or other
atgttcaatagatactatcttgcaacaagattgcacttgggtttggtcgtctgctgttgtgcactaccatgtgacgttgtgctcgtccattctgttcccgtccaggtccgcaaagtcgcggaggagaacggcgtggacgtcacggagcagatccgcgagctggaggaccgcgcgcagcaggtagtcgagtctgtgtggagaggggtgggatactttggaagaatgggtgctgtggagtccagtcatttgaaggaaagggtagtcgacttccctctgtggtcgtatctatcttctccaagcatatctcactttgcccctcttctccgcccccctccattaccaacccgtccacagttgcgaaaggagacgtactccaagctgacgccgatccagcggctgcaggtggcgcgccaccccaaccgccccactttcttggacattgcgctcaacatcacggacaagtttgtggagctgcacggcgatcgcgcggggtacgacgacccgnnnnnnnnnnagaacggcgtggacgtcacggagcagatccgcgagctggaggaccgcgcgcagcagtgtagtcaacttttctgtggttctatccatcttccccaagtatatctcaccccctcttccccccctctcccctttaacaacaccccgtccacagttgcgaaaggagacatactccaagctgacgccgatccagcggctgcaggtggcgcgccaccccaaccgccctactttcttggacattgcgctcaacatcacggacaagtttgtggagctgcacggcgaccgcgcggggtacgacgaccccgcgctcgtctgcggcatcgcgtcgatcgacaacgtgagcttcatgttcatgggccaccagaagggccgcaacaccaaggagaacatctaccgcaatttcggcatgccgcagcccaacggctaccgcaaggcgctgcgcttcatgcgcctggcgnnnnnnnnnncgacaacgtgagcttcatgttcatgggccaccagaagggccgcaacaccaaggagaacatctaccgaaactttggcatgccgcagcccaacggctaccgcaaggcgctgcgcttcatgcgcctggccgacaagtttggcttccccatcgtcacgtttgtggacacgcccggcgcgtacgcggggctcaaggccgaggagctgggccagggcgaggccatcgcggtcaacctgcgcgagatgtttggcttccgcgtgcccatcatctccatcgtcatcggcgagggcggctccggcggcgcgctggccatcggctgcgccaaccgcatgctcatcatggagaacgcggtgtactacgtggcctctcccgaggcctgcgcggccatcctgtggaagagccgcgacaaggcgggcctggccaccgaggcgctcaagatcacgcccgccgacctggtcaagctcaaggtcatggacgagatcgtgccggagccgctgggcgccgcgcacaccgaccccatgggcgccttcccggccgaggaggccgactacatcgagcagatggccgagcgctggcggtggtgggacagcctgctggaggacaagaaggacatcgtcaacccgccaaagaccgagcacccgggctggctcatcccgggctttgccgagttcgccatcggcgtcgccaaggccgccgacgcgcgccaggcgcgcatggggctcgagggcgagagcgccgcgcacgccaacgacgccggcatcggcaccgagagggacggcggcgccgagggcaacggcgcgaacgccgagaacggggcgcacgacgagtcgtctatcgcggagaccgagtga

SEQ ID NO: 93 - protein, 525 aa, Prototheca moriformis
  MOD_RES (393)..(396): Any amino acid
MAPASVNLTQVCGGANVEFPSVPQGDMGDHGLIQHVDSIAFRATPCPAAVAGRRQFPRGAGPSRRSQRSTGSARLTPSASTPSRLVARAETGTNGSAALTPIHKVLIANRGEIAVRVIRACKELGIKTVAVYSTADRECLHAQLADEAVCIGEAPSSESYLNIPTILSAAMSRGADAIHPGYGFLSENAEFVDICKDHGINFIGPGSEHIRVMGDKATARETMKQAGVPTVPGSDGLVETPEEALEVADQVGFPVMIKATAGGGGRGMRLAMTRDEFLPLLRAAQGEAQAAFGNGAVYLERYVKDPRHIEFQVLADKHGNVIHLGERDCSIQRRNQKLLEEAPSPALTPEVRAAMGEAATNAARSIGYVGVGTIEFLWEPAGFYFMEMNTRIXXXXCARSGHSGVCPGGAGETQAWRAIAHSPGTKEVIGWVCKDSKERPFKRPPRLAGRALESSSNSSTGAASRSAANSVGDGINIQRGGARANRLSKENNTQETRAPFGQTKRERRLEGQVGTQAVEGAPRHM

SEQ ID NO: 94 - protein, 557 aa, Prototheca moriformis
MAPASVNLTQVCCSAGHGLRPARATPCPAAVAGRRQFPRGAGPSRRSQRSTGSARLTPSASTPSRLVARAETGTNGSAALTPIHKVLIANRGEIAVRVIRACKELGIKTVAVYSTADRECLHAQLADEAVCIGEAPSSESYLNIPTILSAAMSRGADAIHPGYGFLSENAEFVDICKDHGINFIGPGSEHIRVMGDKATARETMKQAGVPTVPGSDGLVETPEEALEVADQVGFPVMIKATAGGGGRGMRLAMTRDEFLPLLRAAQGEAQAAFGNGAVYLERYVKDPRHIEFQVLADKHGNVIHLGERDCSIQRRNQKLLEEAPSPALTPEVRAAMGEAATNAARSIGYVGVGTIEFLWEPAGFYFMEMNTRIQVEHPVTEMITGVDLIQEQIRAAMGEPLRLTQEDIVIKGHSIECRINAEDPFKGFRPGPGRVTAYLPPGGPNVRMDSHVYPDYLVPSNYDSLLGKLIVWGEDRQAAIERMKRALDEMVVAGVPTTAPYHLLILDHEAFRAGDVDTGFIPKHGDDLILPPEAARKKPNVVVEAAKRAHSRSKASV

SEQ ID NO: 95 - protein, 71 aa, Prototheca moriformis
MSGTFYSSPAPGEPPFVKVGDSVKKGQTVCIIEAMKLMNEIEAESSGTIVKVVAEHGKPVTPGAPLFIIKP

SEQ ID NO: 96 - protein, 323 aa, Prototheca moriformis
  MOD_RES (237)..(240): Any amino acid
MPSFTKALPRLGGGLVPKPAVSVTDSGKSDLLMRFFESDWFDAWIALTYVALGSEGRSCVEMAGLRAVRRFGTDWGHPGEWVWLERRVGLLREVVWPGRSRQSDALGPCIGVGGRARAGFKIARVQLTPLGDDYVTHYKPTRPPSRPPPLTAGCGDLPVAAHPAVHAAAQQLARARPDRPLLALAAHCGQDVLAAPRHQPGQPHRHARHRAPRSMRAGRPGRHLGTRGEETEGGRTXXXXPAGGPCRPPAAPPPPAPAVEGVEISSPMSGTFYSSPAPGEPPFVKVGDSVKKGQTVCIIEAMKLMNEIEAEVGDSGVVAVKEG

SEQ ID NO: 97 - protein, 538 aa, Prototheca moriformis
MSDPVASGCDSMTSSQCRVGAWASPMAVARTRAVARPIPRSRNPRLRVRAGIDPPDLPKPREEEKKHGDWFQMLLSRFNPISEKATNATVLDFEKPLVELDHKIREVRKVAEENGVDVTEQIRELEDRAQQLRKETYSKLTPIQRLQVARHPNRPTFLDIALNITDKFVELHGDRAGYDDPALVCGIASIDNVSFMFMGHQKGRNTKENIYRNFGMPQPNGYRKALRFMRLADKFGFPIVTFVDTPGAYAGLKAEELGQGEAIAVNLREMFGFRVPIISIVIGEGGSGGALAIGCANRMLIMENAVYYVASPEACAAILWKSRDKAGLATEALKITPADLVKLKVMDEIVPEPLGAAHTDPMGAFPAVREAILRHWRELQPLSPVQMRADRYMKFRHIGVYAEHMVPGGQIEAVEAFRESLPGAKTKAGTYAPTQEEADYIEQMAERWRWWDSLLEDKKDIVNPPKTEHPGWLIPGFAEFAIGVAKAADARQARQGLEGESAAHANDAGIGTERDGSAEVNGANAKNGAHDESLAEAE

SEQ ID NO: 98 - protein, 311 aa, Prototheca moriformis
MLLSRFNPISEKATNATVLDFEKPLVELDHKIREVRKVAEENGVDVTEQIRELEDRAQQVVESVWRGLRKETYSKLTPIQRLQVARHPNRPTFLDIALNITDKFVELHGDRAGYDDPALVCGIASIDNVSFMFMGHQKGRNTKENIYRNFGMPQPNGYRKALRFMRLADKFGFPIVTFVDTPGAYAGLKAEELGQGEAIAVNLREMFGFRVPIISIVIGEGGSGGALAIGCANRMLIMENAVYYVASPEACAAILWKSRDKAGLATEALKITPADLVKLKVMDEIVPEPLGAAHTDPMGAFPAVREAILRH

SEQ ID NO: 99 - DNA, 933 bp, Prototheca moriformis; identical to SEQ ID NO: 91

SEQ ID NO: 100 - DNA, 2010 bp, Prototheca moriformis
atggatctcttccgcagcgaggaggtgcacctgatgcagctcatgatccccgccgaggtcgcccacgacacgatggtggccctgggcgaggtggggatgctgcagttcaaggacctcaaccccgacaagccggccttccagcgcacgttcgccaaccagatcaagcggtgcgacgagatggcgcggcagctgcgcttcttccaggcggagctggacaagcacgaggtgcccgcttcgcggcgcgcgggcgacccgcccagccccgacctggaccagctggagtcgcagcttgcggcgctggagtcggagctggtgcagctcaacggcaacgcggagcgcctgggactaggcggtcggcccgcgcctgtcgtccctttggaggaggagaagaagcacggcgactggttccaaatgctgctctcgcgcttcaaccccatcagcgagaaggccaccaacgccacggtgctcgactttgagaaacctttggtggaacttgatcataaaattcgcgagttgcgaaaggagacatactccaagctgacgccgatccagcggctgcaggtggcgcgccaccccaaccgccctactttcttggacattgcgctcaacatcacggacaagtttgtggagctgcacggcgaccgcgcggggtacgacgaccccgcgctcgtctgcggcatcgcgtcgatcgacaacgtgagcttcatgttcatgggccaccagaagggccgcaacaccaaggagaacatctaccgaaactttggcatgccgcagcccaacggctaccgcaaggcgctgcgcttcatgcgcctggccgacaagtttggcttccccatcgtcacgtttgtggacacgcccggcgcgtacgcggggctcaaggccgaggagctgggccagggcgaggccatcgcggtcaacctgcgcgagatgtttggcttccgcgtgcccatcatctccatcgtcatcggcgagggcggctccggcggcgcgctggccatcggctgcgccaaccgcatgctcatcatggagaacgcggtgtactacgtggcgtccccggaagcctgtgcggccatcctgtggaagagccgcgacaaggcgggcctggccaccgaggcgctcaagatcacgcccgccgacctggtcaagctcaaggtcatggacgagatcgtacccgagccgctgggcgccgcgcacaccgaccccatgggcgccttcccggccgtgcgcgaggccattcgccagaaaaacgtcgtggaaaactttgaggcggcgctggagtacaaccccgaggcgtttggcaccgtcaccatgctgtacgtgcccatgacggtcaacggcacgcccctcaaggcctttatcgattcgggcgcacagatgaccatcatgtcccgcagctgcgcggagcggtgcgggctgctccgtctcatggacacgcggtggcaggggacagccgtcggcgtcggctcggccaagatcctggggaggatccacatggctccgctggtcgcggccggccaccacctgcccatctccatcaccgtgctggatcaggagggcatggactttctctttgggctggacaacctcaagcggcaccaatgctgcatcgacctgaaggcaaacgcgcttcggtttgggtcgacagaggccgagatcccgtttctgccggagcacgaggtccccaggcatcagcaccagctcgccggggaggacgccgcgagcggtagaaccgcagccacggcccctcccagcaccgctcccgcaccgaccaaccagcccacagtgcaagcagctccgccagcaccaaatgctcagctggaggaaaaggtgtcgaaactcatgggcctgggcggcgtgatccagctatgggattaccgcatgggcacgctcatcgatcgattcgaggagcatgagggacccgtgcgtggcgtgcactttcatcccacccagccgctcttcgtgtctggcggggacgactacaagatcaaagtgtggaactacaagacgcgc

SEQ ID NO: 101 - DNA, 216 bp, Prototheca moriformis
atgtccggcactttctactcctcccccgcccccggcgagccaccgtttgtcaaggtcggcgacagcgtcaagaagggccagacggtctgcatcatcgaggccatgaagctgatgaacgagatcgaggccgagtcttctggaacaatcgtcaaggttgtggccgagcacggcaagcctgtcacccccggcgcccccctgttcatcatcaagccctga

SEQ ID NO: 102 - DNA, 972 bp, Prototheca moriformis
  modified_base (709)..(718): a, c, t, g, unknown or other
atgccgagctttaccaaggcgctccccaggctgggagggggactggtccccaagcccgcagtgagcgtgacggacagcggcaagtccgacttgctcatgcgtttctttgagagcgattggttcgacgcctggattgctcttacgtacgttgcgctcggttcggaggggcgttcctgtgtcgagatggcggggttgcgagctgtgagacgttttggaacggattgggggcaccctggggagtgggtttggctggagcggcgggtgggcttgttgagggaggtggtctggcctggtcgttcaaggcagtctgacgcattggggccgtgcattggcgtcggggggcgtgcccgcgctggtttcaaaatcgctcgcgtccaattgacgccattaggtgatgattatgtgacgcattacaaacccacccggcccccgtcgcgcccgcccccgttgacagcgggatgtggagacctacctgtcgcagctcacccagctgtgcatgctgcagcccaacagctcgctcgagcgcgtcctgatcgacctctgctcgcgctcgctgcgcattgcggtcaagacgtactggctgctcctcgccatcagccaggacaaccccacagacacgcacgtcatcgcgctccgcgatcgatgcgagcaggccgccctggaaggcacctgggtacgaggggagaggagacagagggggggaggaccnnnnnnnnnncaccggccggcgggccttgtcggcctcccgccgcgccgccgccgcccgcccccgccgtcgagggcgtggagatcagctcgcccatgtccggcaccttctactcctcccccgcccccggcgagccgccgtttgtcaaggtcggcgacagcgtcaagaagggccagacggtctgcatcatcgaggccatgaagctcatgaacgagatcgaggccgaggtgggcgacagcggagtggtggcggtgaaagaggggtaa

SEQ ID NO: 103 - DNA, 327 bp, Prototheca moriformis
  modified_base (9)..(9): a, c, t, g, unknown or other
  modified_base (129)..(129): a, c, t, g, unknown or other
atgatcacnggcgtggacctgatccaggagcagatccgcgccgccatgggcgagccgctgcgcctgagacaggaggacatcgtgatcaagggccacagcatcgagtgccgcatcaacgcggaggacccnttcaagggcttccgcccggggccggggcgcgtgaccgcctacctgccgcccggcgggcccaacgtgcgcatggacagccacgtctaccccgactacctggtgccctccaactacgactccctgctgggcaagctcatcgtctggggcgaggaccgccaggcggccatcgagcgcatgaagcgcgcgctggacgagatg

SEQ ID NO: 104 - DNA, 1674 bp, Prototheca moriformis
atggcgccagcctctgtcaacctgacccaggtttgctgctccgccgggcatggtctgcgtcccgcgagggcgacgccctgccctgcggcggtggccggccggaggcagttcccccgcggcgccggcccctcccgtcgctcccagcgctcgacgggctccgcgaggttgacgccctctgcctccacgccctcccgcctggtcgcccgcgccgagacgggcaccaatggctccgccgccctgacccccatccacaaggtgctgatcgccaaccgtggcgagatcgcggttcgcgtgatccgggcctgcaaggagctgggcatcaagacggtggccgtctactccacggccgaccgcgagtgcctgcacgcgcagctggcggacgaggcggtgtgcatcggcgaggcgcccagctccgagtcctacctcaacatcccgaccatcctctcggcggccatgtcgcgcggcgcggacgcgatccaccccggctacggctttctgtccgagaacgccgagtttgtggacatctgcaaggaccacggcatcaacttcatcggccccgggtcggagcacatccgcgtgatgggcgacaaggccaccgcgcgcgagacgatgaagcaggcgggcgtgccgacggtgcccggctcggacgggctggtggagacgcccgaggaggcgctggaggtggcggaccaggtgggcttccccgtgatgatcaaggccacggccggcggcggcgggcgcggcatgcgcctggccatgacgcgcgacgagtttttgccgctgctgcgcgcggcgcagggcgaggcgcaggcggcctttggcaacggcgccgtctacctggagcgctacgtgaaggacccgcggcacatcgagttccaggtgctggcggacaagcacggcaacgtgatccacctgggcgagcgcgactgctccatccagcgccgcaaccagaagctgctggaggaggcgcccagccccgcgctcacgcccgaggtgcgcgcggccatgggcgaggcggccaccaacgccgcgcgcagcatcggctacgtgggcgtgggcaccatcgagttcctgtgggagccggccggcttctacttcatggagatgaacacgcgcatccaggtggagcacccggtgacggagatgatcacgggcgtggacctgatccaggagcagatccgcgccgccatgggcgagccgctgcgcctgacgcaggaggacatcgtgatcaagggccacagcatcgagtgccgcatcaacgcggaggacccgttcaagggcttccgcccggggccggggcgcgtgaccgcctacctgccgcccggcgggcccaacgtgcgcatggacagccacgtctaccccgactacctggtgccctccaactacgactccctgctgggcaagctcatcgtctggggcgaggaccgccaggcggccatcgagcgcatgaagcgcgcgctggacgagatggtcgtcgccggcgtgcccaccaccgcgccctaccacctgctcatcctcgaccacgaggccttccgcgcgggcgacgtcgacacgggcttcatccccaagcacggcgacgacctcatcctgcccccggaggccgcgcgcaagaagccaaacgtcgtcgtcgaggccgccaagcgcgcccacagccgcagcaaggcctccgtctga

SEQ ID NO: 105 - DNA, 1476 bp, Prototheca moriformis
atggccaccgcatccactttctcggcgttcaatgcccgctgcggcgacctgcgtcgctcggcgggctccgggccccggcgcccagcgaggcccctccccgtgcgcgggcgcgccgccgccgccgccgacgccaaccccgcccgccccgagcgccgcgtggtgatcaccggccagggcgtggtgacctccctgggccagaccatcgagcagttctactcctccctgctggagggcgtgtccggcatctcccagatccagaagttcgacaccaccggctacaccaccaccatcgccggcgagatcaagtccctgcagctggacccctacgtgcccaagcgctgggccaagcgcgtggacgacgtgatcaagtacgtgtacatcgccggcaagcaggccctggagtccgccggcctgcccatcgaggccgccggcctggccggcgccggcctggaccccgccctgtgcggcgtgctgatcggcaccgccatggccggcatgacctccttcgccgccggcgtggaggccctgacccgcggcggcgtgcgcaagatgaaccccttctgcatccccttctccatctccaacatgggcggcgccatgctggccatggacatcggcttcatgggccccaactactccatctccaccgcctgcgccaccggcaactactgcatcctgggcgccgccgaccacatccgccgcggcgacgccaacgtgatgctggccggcggcgccgacgccgccatcatcccctccggcatcggcggcttcatcgcctgcaaggccctgtccaagcgcaacgacgagcccgagcgcgcctcccgcccctgggacgccgaccgcgacggcttcgtgatgggcgagggcgccggcgtgctggtgctggaggagctggagcacgccaagcgccgcggcgccaccatcctggccgagctggtgggcggcgccgccacctccgacgcccaccacatgaccgagcccgacccccagggccgcggcgtgcgcctgtgcctggagcgcgccctggagcgcgcccgcctggcccccgagcgcgtgggctacgtgaacgcccacggcacctccacccccgccggcgacgtggccgagtaccgcgccatccgcgccgtgatcccccaggactccctgcgcatcaactccaccaagtccatgatcggccacctgctgggcggcgccggcgccgtggaggccgtggccgccatccaggccctgcgcaccggctggctgcaccccaacctgaacctggagaaccccgcccccggcgtggaccccgtggtgctggtgggcccccgcaaggagcgcgccgaggacctggacgtggtgctgtccaactccttcggcttcggcggccacaactcctgcgtgatcttccgcaagtacgacgagatggactacaaggaccacgacggcgactacaaggaccacgacatcgactacaaggacgacgacgacaagtga

SEQ ID NO: 106 - protein, 476 aa, Prototheca moriformis
MATASTFSAFNARCGDLRRSAGSGPRRPARPLPVRGRAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDEMDYKDHDG

SEQ ID NO: 107 - DNA, 843 bp, Prototheca moriformis
atggttttgaacgcggggagttcgtccctcaagttcaaggtgtttgacaagatcgggggcaagctgcagcccctggcgtccggtctgtgcgagcgcatcggcgacaccgccaactcccgcatgaaggcctttacggaaaaggacggcaacgtgctggtggaggagggtttccaggaccaccaggacgcgctcggggtcgtgtcgcgctttcttggtgatgccttttcgtccggcttcacggagcgcatgcacagcgtgggacaccgcgtggtgcacggcctgacgatcagcgagcccgtgctgatcgacgagggcgtgctcgcgaccatccgcgaggcgatcgacctcgcgccgctgcacaacccggccgggctgcagggcatcgaggcggccatgcgcacctttgcctcggcgccgcacgtggccgtgtttgacacggccttccacccgctctgcgcgcgcaacctggggctctacctggcggtgcgcgcggacggccacgggcggccgcagtaccgcgtgtactgcgcggtccactcggcgcgcgagcaggagcgcgaccgcaaggcctggcaggcgcggcaggaggcggcgcgcgcctcggccgacctggaggcgcggcgcggccaggcgctcgcgcgcctggccgagctgggctgggtcctgctcctccaggtgcacgacgaggtcatcctggaagggccgcgcgagtccgccgacgaggcgcgcgagcgcgtcgttgcctgcatgcgcagccctttcacgggcgccaccgcgcagcccctgctcgtcgacctggtcgtcgacgccaagcacgccgacacctggtacgacgccaagtag

SEQ ID NO: 108 - protein, 280 aa, Prototheca moriformis
MVLNAGSSSLKFKVFDKIGGKLQPLASGLCERIGDTANSRMKAFTEKDGNVLVEEGFQDHQDALGVVSRFLGDAFSSGFTERMHSVGHRVVHGLTISEPVLIDEGVLATIREAIDLAPLHNPAGLQGIEAAMRTFASAPHVAVFDTAFHPLCARNLGLYLAVRADGHGRPQYRVYCAVHSAREQERDRKAWQARQEAARASADLEARRGQALARLAELGWVLLLQVHDEVILEGPRESADEARERVVACMRSPFTGATAQPLLVDLVVDAKHADTWYDAK

SEQ ID NO: 109 - DNA, 849 bp, Prototheca moriformis
atgaaggtattcgcagattttgggggcggacttggggctggcgtgggttcgccttgctccgcccatggggtttgggtgcagatcacgatgaatgagagagagagggaggagagtggggcactgcgtggtgggtggggtttgttggtcgctcctctccaggtctccagaagacaaggagaaatggagggcctttacggaaaaggacggcaacgtgctggtggaggagggtttccaggaccaccaggacgcgctcggggtcgtgtcgcgctttcttggcgatgccttttcgtccggcttcacggagcgcatgcacagcgtggggcaccgcgtggtgcacgggctgacgatcagcgagcccgtgctgatcgacgagggcgtgatcgcgaccatccgcgaggcgatcgacctggcgccgctgcacaacccggccgggctgcagggcatcgaggcggccatgcgcacctttgcctcggcgccgcacgtsgcccgtggcgtgcgccgctacggcttccacggctccagctacgcgtacctcgtcccgcgcgccgcggccgtgctgggcaagcccgccgccgagctgmmscgccaggcgctcaggtccgccatccagcccttccacacggggccgtcgaaggctggacggtggcggggccgctgcttgtcggcgctggtgccgtcctcttcgtcgctgctggtgctgacctcatcgggctgtcgcagcaggctggcgttgcaggccgtgggttgcagctccacgaggaccctgccgtggtgtgcgggtgggggtgggtgagcgggacagccgtggtgagcgggctgcgaatgcagttgcgccaatcaggcgcctga

SEQ ID NO: 110 - protein, 282 aa, Prototheca moriformis
  UNSURE (162)..(162): Unknown amino acid
  UNSURE (194)..(195): Unknown amino acid
MKVFADFGGGLGAGVGSPCSAHGVWVQITMNEREREESGALRGGWGLLVAPLQVSRRQGEMEGLYGKGRQRAGGGGFPGPPGRARGRVALSWRCLFVRLHGAHAQRGAPRGARADDQRARADRRGRDRDHPRGDRPGAAAQPGRAAGHRGGHAHLCLGAARXPWRAPLRLPRLQLRVPRPARRGRAGQARRRAXXPGAQVRHPALPHGAVEGWTVAGPLLVGAGAVLFVAAGADLIGLSQQAGVAGRGLQLHEDPAVVCGWGWVSGTAVVSGLRMQLRQSGA

SEQ ID NO: 111 - DNA, 1200 bp, Prototheca moriformis
atggttttgaacgcggggagttcgtccctgaagttcaaggtgtttgacaagatcggagggaagctgcagcccctggcgtccggtctgtgcgagcgcatcggcgacaccgccaactcccgcatgaaggcctttacggaaaaggacggcaacgtgctggtggaggagggtttccaggaccaccaggacgcgctcggggtcgtgtcgcgctttcttggtgatgccttttcgtccggcttcacggagcgcatgcacagcgtggggcaccgcgtggtgcacgggctgacgatcagcgagcccgtgctgatcgacgagggcgtgatcgcgaccatccgcgaggcgatcgacctggcgccgctgcacaacccggccgggctgcagggcatcgaggcggccatgcgcacctttgcctcggcgccgcacgtcgccgtgttcgacacggctttccaccagaccatgccgcccagcgccttcatgtacgcgctgccctacgagctgtacgaggcgcagggcgtgcgccgctacggcttccacggctccagctacgcctacctcgtcccgcgcgcggcggccgcgctgggcaagcccgccgccgagctgaacgcggtcgtctgccacctgggcgccggcgccagcatggccgccatccgcggcgggcgctcggtggacaccaccatgggcctcaccccgctggagggcctkgtcatgggcacgcgctgcggcgacatcgaccccgccatcgtgacctacctgctgggcaagggccactcggccaaggacgtggacgcgctcatgaacaagaagagcggcttygccggsctggcmgggcacgccgacctgcgcctggtcatcgagggcgccgacaagggcgacgagcgctgccgcgtcgcgctggaggtctggcgccaccgcatccgcaagtacatcggsgcctacgcgatgcagctgggcgcgccsctggacgccatcgtcttctccgccggcatcggcgagaacagctccatcctgcgcaagtacctgctggaggacctggagtggtggggcatcgagctggacgagggcaagaacagtctctgcgtggacggcgtcgcgggcgacatctcccgcgayggctcyaagacccgcctgctcgtcatccccaccgacgaggagctsagcatcgccgaacagagcatcgacgtcgtcaacggcctggccgcctga

SEQ ID NO: 112 - protein, 399 aa, Prototheca moriformis
MVLNAGSSSLKFKVFDKIGGKLQPLASGLCERIGDTANSRMKAFTEKDGNVLVEEGFQDHQDALGVVSRFLGDAFSSGFTERMHSVGHRVVHGLTISEPVLIDEGVIATIREAIDLAPLHNPAGLQGIEAAMRTFASAPHVAVFDTAFHQTMPPSAFMYALPYELYEAQGVRRYGFHGSSYAYLVPRAAAALGKPAAELNAVVCHLGAGASMAAIRGGRSVDTTMGLTPLEGLVMGTRCGDIDPAIVTYLLGKGHSAKDVDALMNKKSGFAGLAGHADLRLVIEGADKGDERCRVALEVWRHRIRKYIGAYAMQLGAPLDAIVFSAGIGENSSILRKYLLEDLEWWGIELDEGKNSLCVDGVAGDISRDGSKTRLLVIPTDEELSIAEQSIDVVNGLAA

SEQ ID NO: 113 - DNA, 2319 bp, Prototheca moriformis
atgagtctgtcgtcttctcggagtttgcggcggacgctgagcctgctgaggccggtggcggcgtccacgcccctgtttgcgcgccacctgtcgagccgcggcatcccggacgcggacacggtctactgcacggacgtctccgcgcagcgcggcaactcgcccatcctgctgggcctgtttgagtacttccagcgccagtcgcccgacgtgggcttcttccagcccatcggcgcggacccgctgaagagctacaagccggcccccggcgcgcccaagcacatcgcgctcatccaccaggccatgggcctgaaggactcgcccgagtcgatgtacggcgtgaccgaggacgaggccaagcgcctgctgacggcggggcgctacgacgagctggtggaccgcgtgttcaccaagttccaggcggtcaagcgcagcaaggagatcgtggtgatcgagggcgccaccgtgcagggcatcggcaaccacaacgagctcaacgcgcgcctggcctccgagctggacagcggcgtgctgatgatcatggacctcaacagcgacgcgccggggagcggcgaggacatcgccgggcgcgcgctgcggtacaagcgcgagttcgaggcggagcgcgcgcgcgtgagcgggctcatcctgaacaaggtgccctttggcgcggaggaggcgctgatcgaggcggtccggcgcgagctggagggccgggacctgccctttgcgggcggcctgccctacagccgcgtcatcggcaccgcacgcgtgaacgagatcgtcgagtcgctgggcgccaagctgctgttcgggcggcaggagctgatcgacagcgacgtcacggggtacatgatcgccgcgcaggccatcgacgcctttctgacgaaactagagacgctgcgctcgcagcgcacgagcgagggccaggactttttccggccgctggtggtgaccaacaaggaccggcaggacctgatcctgggcctggcggccgcgtccctggcgggcacgggcccgcagctgggcgggctcatcctcgcggacgcggacctgaccgacctgacccccgagacgcgcgcgatcgttagcaagctcaacccggacctgcccatgctggaggtgccctacggcacctttgagacggcgcgccgcctgacgcgcgtgacgccgggcatcctgcccagctcggtgcgcaaggttcgcgaggccaaggcgctcttccaccggtacgtggacgcagacgtcatcgcggccgggctggtgcggccgcagcgccccagcctgacccccaagcgcttcctgtaccagatcgaggagatctgcaagggcgagctgcagaacgtggtgctccccgagtcgcacgaccaccgtgtgctcacggccgcggccgaggtcgcggccaagggcctggcgcgcgtgacgctgctgggcagccccgaggaggtggagtcggccgcgcgccgcttcaacgtcgacatcagcaagtgcgacgtgatcgactacaagcactcgcccgagctggaccggtacgcggactggctggtggagaagcgcaaggccaagggcctgaccaaggagggcgcgctggaccagctgcaggacctcaacatgtacgccaccgtcatggtggccgtcggcgacgcggacggcatggtgtcgggcgcgacctgcaccacggccaacaccatccggcctgcgctgcaggtgctcaagacgcccgaccgcaagctcgtctcctccatcttcttcatgtgcctgccggacaaggtcctcgtctacggcgactgcgcggtcaacgtgacgcccgcgccgggcgagctggcgcagatcgcgaccgtgtcggccgacacggccgccgcctttggcatcgacccgcgcgtggccatgctctcctactcgaccctgggctctggctcggggccgcaggtggacatggtcaccgaggccacgcgcctcgcgcgcgaggcgcgccccgacctcaacattgaggggcccatccagtacgacgccgctgtcgaccccgccgtggccgccaccaagatcaaggcgcactccgaggtcgcggggcgcgcctccgtctgcatcttcccggatctcaacacggggaacaacacctacaaggccgtgcagcagtccacgggcgccatcgccatcggaccgctcatgcagggcctcgcgcgccccgtcaacgatctctcccgcggctgcaccgtcgccgacatcgtcaacaccgtcgcctgcacggccgtccaggccatcgggctcaaagcgcgcgacgccgaggcggcgcgcgcgggggccgcggctgctgctgcttga

SEQ ID NO: 114 - protein, 772 aa, Prototheca moriformis
MSLSSSRSLRRTLSLLRPVAASTPLFARHLSSRGIPDADTVYCTDVSAQRGNSPILLGLFEYFQRQSPDVGFFQPIGADPLKSYKPAPGAPKHIALIHQAMGLKDSPESMYGVTEDEAKRLLTAGRYDELVDRVFTKFQAVKRSKEIVVIEGATVQGIGNHNELNARLASELDSGVLMIMDLNSDAPGSGEDIAGRALRYKREFEAERARVSGLILNKVPFGAEEALIEAVRRELEGRDLPFAGGLPYSRVIGTARVNEIVESLGAKLLFGRQELIDSDVTGYMIAAQAIDAFLTKLETLRSQRTSEGQDFFRPLVVTNKDRQDLILGLAAASLAGTGPQLGGLILADADLTDLTPETRAIVSKLNPDLPMLEVPYGTFETARRLTRVTPGILPSSVRKVREAKALFHRYVDADVIAAGLVRPQRPSLTPKRFLYQIEEICKGELQNVVLPESHDHRVLTAAAEVAAKGLARVTLLGSPEEVESAARRFNVDISKCDVIDYKHSPELDRYADWLVEKRKAKGLTKEGALDQLQDLNMYATVMVAVGDADGMVSGATCTTANTIRPALQVLKTPDRKLVSSIFFMCLPDKVLVYGDCAVNVTPAPGELAQIATVSADTAAAFGIDPRVAMLSYSTLGSGSGPQVDMVTEATRLAREARPDLNIEGPIQYDAAVDPAVAATKIKAHSEVAGRASVCIFPDLNTGNNTYKAVQQSTGAIAIGPLMQGLARPVNDLSRGCTVADIVNTVACTAVQAIGLKARDAEAARAGAAAAAA

SEQ ID NO: 115 - DNA, 1731 bp, Prototheca moriformis
atggtcaacgacttggtgggagccatggcgatggtcggcgacggcaagcacgggcgcagggcagcacggggcggtcagcgaggggcttgggtgcaactgtgtgggtcgtcagcaggccctaatcaatccagggacccttcttcagcgcaattggcctcgttctatcgcgatcgcgatgacatatactctcgtcacctcaaggggttgagcgagttcgcattcataagtcagtggcatcggtcttgccgggtttgggcattgtgcctgggtctgatctggaaacccgactcgccgaaggtgcccatcggccggtcatcgcgggacccccccacccccgccggcctcgttgattggcagcatgagtctgtcgtcttctcggagtttgcggcggacgctgagcctgctgaggtgcgatgcaagggcgtccctgggcgatttgacgggcggttacctaaggcggagcgacgtgcggctccggcgggcagccgacacgtgggcttgttgccatggacaggcccagatcccgatccgatgggccctgtaacgtttgcttatttgccgacgccctttgccacggcctgcccgccagaaatgccgggcagcgccccgttgcgccgcttccccatgcttctcgcctcgaatcacatttcgacactcctccgacgtctctccacccctccccgaatcacgcaggccagtggcggcgtccacgcacctgtttgcgcgccacctgtcgagccgcggcatcccggacgcggacacggtctactgcacggacgtctccgcgcagcgcggcaactcgcccatcctgctgggcctgttcgagtacttccagcgccagtcgcccgacgtgggcttcttccagcccatcggcgcggacccgctgaggagctacaagcctgcccccggcgcgcccaagcacatcgcgctcatccaccaggccatgggcctgaaggactcgcccgagtcgatgtacggcgtgaccgaggacgaggccaagcgcctgctgacggcggggcgctacgacgagctggtggaccgcgtgttcaccaagttccaggcggtcaaacgcagcaaggagattgtggtgatcgagggcgccaccgtgcagggcatcggcaaccacaacgagctcaacgcgcgcctggcctccgagctggacagcggcgtgctgatgatcatggacctsaacmgsgacgcsccsggsagcggcgaggacatcgccgggcgcgcgctgcggtacaagcgcgagttcgaggcggagcgcgcgcgcgtgagcgggctcatcctgaacaaggtgccctttggcgcggaggaggcgctgatcgaggcggtccggcgcgagctggagggccgggacctgccctttgcgggcggcctgccctacagccgcgtcatcggcaccgcgcgcgtgaacgagatcgtcgagtcgctgggcgccaagctgctgttcgggcggcasgagctgatcgacagcgacgtcacggggtacatgatcgccgcgcaggccatcgacgcsttyctgacsaarctrgagacgctgcgctcgcagcgcacgagcgagggccaggactttttccggccgctggtggtgaccaacaaggaccggcaggacctgatcctgggcctggcggccgcgtcsctggcgggcacgggcccgcagctgggcgggctcatcctsgcsgacgcggacctgaccgacctgacccccgagacgcgcgcgatcgttag

SEQ ID NO: 116 - protein, 396 aa, Prototheca moriformis
MVNDLVGAMAMVGDGKHGRRAARGGQRGAWVQLCGSSAGPNQSRDPSSAQLASFYRDRDDIYSRHLKGLSEFAFISQWHRSCRVWALCLGLIWKPDSPKVPIGRSSRDPPTPAGLVDWQHESVVFSEFAADAEPAEVRCKGVPGRFDGRLPKAERRAAPAGSRHVGLLPWTGPDPDPMGPVTFAYLPTPFATACPPEMPGSAPLRRFPMLLASNHISTLLRRLSTPPRITQASGGVHAPVCAPPVEPRHPGRGHGLLHGRLRAARQLAHPAGPVRVLPAPVARRGLLPAHRRGPAEELQACPRRAQAHRAHPPGHGPEGLARVDVRRDRGRGQAPADGGALRRAGGPRVHQVPGGQTQQGDCGDRGRHRAGHRQPQRAQRAPGLRAGQRRADDHGP

SEQ ID NO: 117 - DNA, 1022 bp, Prototheca moriformis
atggctgaggggagcatcgactacaaggtggctgtcttcagctccagcgagtgggtgaccgactcgttcgccgagcccctcaagatcttcaaggaggtctcctacctgccggcccgcctggagccgaccagcgctgccctggcgcacggctttgacgcggtgtgcatctttgtgaacgacgacgctggcgcggagacgctcaaggttctggcggagggcggcgtgaagctgatcgccatgcgctgcgcagggtacgaccgcgtggacctggccgcggccaaggagctgggcatccgcgtggtgcgcgtgccggcctacagtccgcgctcggtggcggagcacgcgctggcgctgatgatggcgctggcgcgcaacatcaaggcctcgcagatcaagatggcggccgggtcctacacgctcaacggcctggtgggcgtggagctgacgggcaagacctttggcgtggtgggcacgggcgccatcgggcgcgagttcgtcaagctgctcaagggctttgagggcaaggtgctgggctacgacccctacccgaccgacgcggcgcgcgagctgggcgtggagtacgtcgacctggacacgctgctggcgcagtcggacgtcatctcgctgcacgtgccgctgctgcccagcacgcagaagctgctgggcaccgagtcgctgagcaagctcaagcccaccgcgctggtcatcaacgtcagccgcggcgggctcatcgacaccgaggcctgcatccaggcgctgcaggaggacaagtttgcgggcctggccgtcgacgtctacgagggcgagggcgcgctcttcttccaggactgggccaacatgaacgccgcgcgccgcatgaagcagtgggaccagaagttcatcgcgctcaagtccatgccccaggtcatcgtcacgccgcacatcgccttcctcacgcacagcgcgctcgacgccatcgccgccaccacgcgcgacaacctgctcgccgccgcgcagggcaaggacctcgtcaacgaggtcaa

SEQ ID NO: 118 - protein, 340 aa, Prototheca moriformis
MAEGSIDYKVAVFSSSEWVTDSFAEPLKIFKEVSYLPARLEPTSAALAHGFDAVCIFVNDDAGAETLKVLAEGGVKLIAMRCAGYDRVDLAAAKELGIRVVRVPAYSPRSVAEHALALMMALARNIKASQIKMAAGSYTLNGLVGVELTGKTFGVVGTGAIGREFVKLLKGFEGKVLGYDPYPTDAARELGVEYVDLDTLLAQSDVISLHVPLLPSTQKLLGTESLSKLKPTALVINVSRGGLIDTEACIQALQEDKFAGLAVDVYEGEGALFFQDWANMNAARRMKQWDQKFIALKSMPQVIVTPHIAFLTHSALDAIAATTRDNLLAAAQGKDLVNEV

SEQ ID NO: 119 - DNA, 1016 bp, Prototheca moriformis
  modified_base (6)..(6): a, c, t, g, unknown or other
atggcngctgtcgctgagaaccccgctcccccccgcccgaacagccttaagaagctgggcttcgttcccgaggccggcgcgaagagctacgagattgccaccaatgtctacactacggcaaagagctacgttcccgctagcctgcagcccaagctggagaaggtggaggagtctgtgaccagcgtgagcgccccgtacgtggccaaggcccaggacaagaccgcgaccctgctcaaggtggccgacgagaaggttgatgaggccttcgccaaggccacccaggtctaccttaacaacagcaagtacgtcgccgacaccctggacaagcagcgcgcctaccacgcgcagaacctcgagtcctacaaggccgcgcgcgagcactacctcaaggtcgtcgaaagcggcgtcgagtacgtgaagaagaacggcatctccggcaccgccaaggccgccgccgacgaggtggccgcgcgcgtgagcgaggcgcgcgccgtccccggcgccctgctgcaccgcgtgcaggaggccgtggacaagctgctggccagcacgcccgtgcacggcacggtcgagcgcctgaagccggccctggacagcgcctaccagcgctacagctccctgcacgacaacgtcgtctccagcgaccagtaccgcaaggtcgtgaagaccggctcggacgtgctcgcccgcgtcgaggcctcgcccatcttcgccaagtccaaggcgaccctgtacccctacgtcgcgccctacgcggagcccgcggcagcgcgcctgcagccctactacctccgggtggtcgagcacctcgcgcccaaggacgcctgaatttgtggacgcggcggtcgcactgctgccgcgttgcgcggtctcgcttgatcgcggggctgcccccttggagcgcttgttcgcgccggcgcgacgcgccgtcccagttgattgtcggggcggggcgccgtcaccgcgcgtgggccatcggaattggatctgctgagaatgcaaagggcgaccggtga

SEQ ID NO: 120 - protein, 275 aa, Prototheca moriformis
MAAVAENPAPPRPNSLKKLGFVPEAGAKSYEIATNVYTTAKSYVPASLQPKLEKVEESVTSVSAPYVAKAQDKTATLLKVADEKVDEAFAKATQVYLNNSKYVADTLDKQRAYHAQNLESYKAAREHYLKVVESGVEYVKKNGISGTAKAAADEVAARVSEARAVPGALLHRVQEAVDKLLASTPVHGTVERLKPALDSAYQRYSSLHDNVVSSDQYRKVVKTGSDVLARVEASPIFAKSKATLYPYVAPYAEPAAARLQPYYLRVVEHLAPKDA

SEQ ID NO: 121 - DNA, 726 bp, Unknown; identical to SEQ ID NO: 38
  source: /note="Description of Unknown: 6S 5' genomic donor polynucleotide"

SEQ ID NO: 122 - DNA, 749 bp, Unknown; identical to SEQ ID NO: 39
  source: /note="Description of Unknown: 6S 3' genomic donor polynucleotide"

SEQ ID NO: 123 - protein, 532 aa, Saccharomyces cereviseae
MLLQAFLFLLAGFAAKISASMTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 124 - DNA, 1599 bp, Saccharomyces cereviseae; identical to SEQ ID NO: 16

SEQ ID NO: 125 - DNA, 312 bp, Chlamydomonas reinhardtii; identical to SEQ ID NO: 30

SEQ ID NO: 126 - DNA, 408 bp, Chlorella vulgaris
gcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 127 - DNA, 2333 bp, Artificial Sequence
  source: /note="Description of Artificial Sequence: Synthetic polynucleotide"
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcc

SEQ ID NO: 128 - DNA, 1065 bp, Prototheca moriformis; identical to SEQ ID NO: 37

SEQ ID NO: 129 - DNA, 120 bp, Chlorella protothecoides; identical to SEQ ID NO: 54

SEQ ID NO: 130 - DNA, 1236 bp, Artificial Sequence; identical to SEQ ID NO: 52
  source: /note="Description of Artificial Sequence: Synthetic polynucleotide"

SEQ ID NO: 131 - protein, 408 aa, Cuphea wrightii; identical to SEQ ID NO: 53

SEQ ID NO: 132-136 - skipped (5 entries)

SEQ ID NO: 137 - DNA, 6676 bp, Artificial Sequence
  source: /note="Description of Artificial Sequence: Synthetic polynucleotide"
gggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtga

SEQ ID NO: 138 - DNA, 719 bp, Unknown
  source: /note="Description of Unknown: 5' FADc genomic region donor polynucleotide"
gggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccg

SEQ ID NO: 139 - DNA, 732 bp, Unknown
  source: /note="Description of Unknown: 3' FADc genomic region donor polynucleotide"
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtga

SEQ ID NO: 140 - DNA, 612 bp, Prototheca moriformis; identical to SEQ ID NO: 48

SEQ ID NO: 141 - DNA, 528 bp, Prototheca moriformis; identical to SEQ ID NO: 49

SEQ ID NO: 142 - DNA, 1202 bp, Chlorella protothecoides
actagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaaaacgcctttgtacaactgca

SEQ ID NO: 143 - DNA, 3529 bp, Artificial Sequence
  source: /note="Description of Artificial Sequence: Synthetic polynucleotide"
agtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctgtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaatctagaatggccgcgtccgtccactgcaccctgatgtccgtggtctgcaacaacaagaaccactccgcccgccccaagctgcccaactcctccctgctgcccggcttcgacgtggtggtccaggccgcggccacccgcttcaagaaggagacgacgaccacccgcgccacgctgacgttcgacccccccacgaccaactccgagcgcgccaagcagcgcaagcacaccatcgacccctcctcccccgacttccagcccatcccctccttcgaggagtgcttccccaagtccacgaaggagcacaaggaggtggtgcacgaggagtccggccacgtcctgaaggtgcccttccgccgcgtgcacctgtccggcggcgagcccgccttcgacaactacgacacgtccggcccccagaacgtcaacgcccacatcggcctggcgaagctgcgcaaggagtggatcgaccgccgcgagaagctgggcacgccccgctacacgcagatgtactacgcgaagcagggcatcatcacggaggagatgctgtactgcgcgacgcgcgagaagctggaccccgagttcgtccgctccgaggtcgcgcggggccgcgccatcatcccctccaacaagaagcacctggagctggagcccatgatcgtgggccgcaagttcctggtgaaggtgaacgcgaacatcggcaactccgccgtggcctcctccatcgaggaggaggtctacaaggtgcagtgggccaccatgtggggcgccgacaccatcatggacctgtccacgggccgccacatccacgagacgcgcgagtggatcctgcgcaactccgcggtccccgtgggcaccgtccccatctaccaggcgctggagaaggtggacggcatcgcggagaacctgaactgggaggtgttccgcgagacgctgatcgagcaggccgagcagggcgtggactacttcacgatccacgcgggcgtgctgctgcgctacatccccctgaccgccaagcgcctgacgggcatcgtgtcccgcggcggctccatccacgcgaagtggtgcctggcctaccacaaggagaacttcgcctacgagcactgggacgacatcctggacatctgcaaccagtacgacgtcgccctgtccatcggcgacggcctgcgccccggctccatctacgacgccaacgacacggcccagttcgccgagctgctgacccagggcgagctgacgcgccgcgcgtgggagaaggacgtgcaggtgatgaacgagggccccggccacgtgcccatgcacaagatccccgagaacatgcagaagcagctggagtggtgcaacgaggcgcccttctacaccctgggccccctgacgaccgacatcgcgcccggctacgaccacatcacctccgccatcggcgcggccaacatcggcgccctgggcaccgccctgctgtgctacgtgacgcccaaggagcacctgggcctgcccaaccgcgacgacgtgaaggcgggcgtcatcgcctacaagatcgccgcccacgcggccgacctggccaagcagcacccccacgcccaggcgtgggacgacgcgctgtccaaggcgcgcttcgagttccgctggatggaccagttcgcgctgtccctggaccccatgacggcgatgtccttccacgacgagacgctgcccgcggacggcgcgaaggtcgcccacttctgctccatgtgcggccccaagttctgctccatgaagatcacggaggacatccgcaagtacgccgaggagaacggctacggctccgccgaggaggccatccgccagggcatggacgccatgtccgaggagttcaacatcgccaagaagacgatctccggcgagcagcacggcgaggtcggcggcgagatctacctgcccgagtcctacgtcaaggccgcgcagaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcc

SEQ ID NO: 144 - DNA, 1476 bp, Chlorella protothecoides; identical to SEQ ID NO: 105

SEQ ID NO: 145 - protein, 491 aa, Chlorella protothecoides
MATASTFSAFNARCGDLRRSAGSGPRRPARPLPVRGRAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDEMDYKDHDGDYKDHDIDYKDDDDK

SEQ ID NO: 146 - DNA, 1107 bp, Prototheca moriformis
atggccatcaagaccaaccgccagcccgtggagaagccccccttcaccatcggcaccctgcgcaaggccatccccgcccactgcttcgagcgctccgccctgcgctcctccatgtacctggccttcgacatcgccgtgatgtccctgctgtacgtggcctccacctacatcgaccccgcccccgtgcccacctgggtgaagtacggcgtgatgtggcccctgtactggttcttccagggcgccttcggcaccggcgtgtgggtgtgcgcccacgagtgcggccaccaggccttctcctcctcccaggccatcaacgacggcgtgggcctggtgttccactccctgctgctggtgccctactactcctggaagcactcccaccgccgccaccactccaacaccggctgcctggacaaggacgaggtgttcgtgcccccccaccgcgccgtggcccacgagggcctggagtgggaggagtggctgcccatccgcatgggcaaggtgctggtgaccctgaccctgggctggcccctgtacctgatgttcaacgtggcctcccgcccctacccccgcttcgccaaccacttcgacccctggtcccccatcttctccaagcgcgagcgcatcgaggtggtgatctccgacctggccctggtggccgtgctgtccggcctgtccgtgctgggccgcaccatgggctgggcctggctggtgaagacctacgtggtgccctacctgatcgtgaacatgtggctggtgctgatcaccctgctgcagcacacccaccccgccctgccccactacttcgagaaggactgggactggctgcgcggcgccatggccaccgtggaccgctccatgggcccccccttcatggacaacatcctgcaccacatctccgacacccacgtgctgcaccacctgttctccaccatcccccactaccacgccgaggaggcctccgccgccatccgccccatcctgggcaagtactaccagtccgactcccgctgggtgggccgcgccctgtgggaggactggcgcgactgccgctacgtggtgcccgacgcccccgaggacgactccgccctgtggttccacaagtag

SEQ ID NO: 147 - protein, 368 aa, Prototheca moriformis
MAIKTNRQPVEKPPFTIGTLRKAIPAHCFERSALRSSMYLAFDIAVMSLLYVASTYIDPAPVPTWVKYGVMWPLYWFFQGAFGTGVWVCAHECGHQAFSSSQAINDGVGLVFHSLLLVPYYSWKHSHRRHHSNTGCLDKDEVFVPPHRAVAHEGLEWEEWLPIRMGKVLVTLTLGWPLYLMFNVASRPYPRFANHFDPWSPIFSKRERIEVVISDLALVAVLSGLSVLGRTMGWAWLVKTYVVPYLIVNMWLVLITLLQHTHPALPHYFEKDWDWLRGAMATVDRSMGPPFMDNILHHISDTHVLHHLFSTIPHYHAEEASAAIRPILGKYYQSDSRWVGRALWEDWRDCRYVVPDAPEDDSALWFHK

SEQ ID NO: 148 - DNA, 1191 bp, Brassica napus
actagtatgctgaagctgtcctgcaacgtgaccaacaacctgcacaccttctccttcttctccgactcctccctgttcatccccgtgaaccgccgcaccatcgccgtgtcctccgggcgcgcctcccagctgcgcaagcccgccctggaccccctgcgcgccgtgatctccgccgaccagggctccatctcccccgtgaactcctgcacccccgccgaccgcctgcgcgccggccgcctgatggaggacggctactcctacaaggagaagttcatcgtgcgctcctacgaggtgggcatcaacaagaccgccaccgtggagaccatcgccaacctgctgcaggaggtggcctgcaaccacgtgcagaagtgcggcttctccaccgacggcttcgccaccaccctgaccatgcgcaagctgcacctgatctgggtgaccgcccgcatgcacatcgagatctacaagtaccccgcctggtccgacgtggtggagatcgagacctggtgccagtccgagggccgcatcggcacccgccgcgactggatcctgcgcgactccgccaccaacgaggtgatcggccgcgccacctccaagtgggtgatgatgaaccaggacacccgccgcctgcagcgcgtgaccgacgaggtgcgcgacgagtacctggtgttctgcccccgcgagccccgcctggccttccccgaggagaacaactcctccctgaagaagatccccaagctggaggaccccgcccagtactccatgctggagctgaagccccgccgcgccgacctggacatgaaccagcacgtgaacaacgtgacctacatcggctgggtgctggagtccatcccccaggagatcatcgacacccacgagctgcaggtgatcaccctggactaccgccgcgagtgccagcaggacgacatcgtggactccctgaccacctccgagatccccgacgaccccatctccaagttcaccggcaccaacggctccgccatgtcctccatccagggccacaacgagtcccagttcctgcacatgctgcgcctgtccgagaacggccaggagatcaaccgcggccgcacccagtggcgcaagaagtcctcccgcatggactacaaggaccacgacggcgactacaaggaccacgacatcgactacaaggacgacgacgacaagtgaatcgat

SEQ ID NO: 149 - protein, 366 aa, Brassica napus
MLKLSCNVTNNLHTFSFFSDSSLFIPVNRRTIAVSSSQLRKPALDPLRAVISADQGSISPVNSCTPADRLRAGRLMEDGYSYKEKFIVRSYEVGINKTATVETIANLLQEVACNHVQKCGFSTDGFATTLTMRKLHLIWVTARMHIEIYKYPAWSDVVEIETWCQSEGRIGTRRDWILRDSATNEVIGRATSKWVMMNQDTRRLQRVTDEVRDEYLVFCPREPRLAFPEENNSSLKKIPKLEDPAQYSMLELKPRRADLDMNQHVNNVTYIGWVLESIPQEIIDTHELQVITLDYRRECQQDDIVDSLTTSEIPDDPISKFTGTNGSAMSSIQGHNESQFLHMLRLSENGQEINRGRTQWRKKSSR

SEQ ID NO: 150 - DNA, 599 bp, Prototheca moriformis
ggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcgg

SEQ ID NO: 151 - DNA, 521 bp, Prototheca moriformis
gacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggt

SEQ ID NO: 152 - DNA, 563 bp, Prototheca moriformis
aatggagtcgctgctccactaatcgaattgtcagcaccgccagccggccgaggacccgagtcatagcgagggtagtagcgcgccatggcaccgaccagcctgcttgcccgtactggcgtctcttccgcttctctgtgctcctctacgcgctccggcgcgtgcgcttttccggtggatcatgcggtccgtggcgcaccgcagcggccgctgcccatgcagcgccgctgcttccgaacagtggctgtcagggccgcacccgcagtagccgtccgtccggaacccgcccaagagttttgggagcagcttgagccctgcaagatggcggaggacaagcgcatcttcctggaggagcaccggtgcgcggaggtccggggctgaccggccgtcgcattcaacgtaatcaatcgcatgatgatcacaggacgcgacgtcttggtggcggtggccagggacactgcccattgcacaggcataggaatgcgttccttctcatttctcagttttctgagcccctccctcttcactctttctcctcctcctcccctctcacgcagcattcgtgg

SEQ ID NO: 153 - DNA, 547 bp, Prototheca moriformis
cactagtatcgatttcgaacagaggagagggtggctggtagttgcgggatggctggtcgcccgtcgatcctgctgctgctattgtctcctcctgcacaagcccacccacgactccgaagaagaagaagaaaacgcgcacacacacaacccaaccggccgaatatttgcttccttatcccgggtccaagagagacggcgatgcccccctcaatcagcctcctcctccctgccgctccaatcttccctgcttgcatgcgcccgcgagaggctgtctgcgcgccccgtcagtcactccccgtgcagacgcctcgtgctcggtgctcctgtatcctttaccgctcctttcattctgcgaggccccctgttgaatgtattcgttgcctgtgtggccaagcgcgctgctgggcgcgccgccgtcgggcggtgctcggcgactctggcggaagccggttgttcttctgtaagccacgcgcttgctgcttttggaaaagaggggggtttactgaatggaggaggagcaggataattggtagtatctgagttgttg

SEQ ID NO: 154 - DNA, 615 bp, Unknown
  source: /note="Description of Unknown: SAD2 hairpin C polynucleotide"
actagtgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgcgaccaagtacagccacggcaacaccgcgcgccttgcggccgagcagtgtgtttgagggttttggttgcccgtatcgaggtcctggtggcgcgcatgggggagaaggcgcctgtcccgctgacccccccggctaccctcccggcaccttccagggcgcgtacgggatcctgctcggccgcaaggcgcgcggtgttgccgtggctgtacttggtcgcgcgctcctggaaggaggtgtagacgaagcccaagtaagggttgttgtccgtctgcgggttcatgccgctcttgatcaggttgttgatggtcacctccacggcccgcatgttgacgcgccccgtcagccaacagtacttgttcagcaggtcgccgtgccggttctcctcggccacccactgccgcgtccagcgcaagctt

SEQ ID NO: 155 - protein, 452 aa, Prototheca moriformis
MSIQFALRAAYIKGTCQRLSGRGAALGLSRDWTPGWTLPRCWPASAAATAPPRARHQERAIHLTSGRRRHSALASDADERALPSNAPGLVMASQANYFRVRLLPEQEEGELESWSPNVRHTTLLCKPRAMLSKLQMRVMVGDRVIVTAIDPVNMTVHAPPFDPLPATRFLVAGEAADMDITVVLNKADLVPEEESAALAQEVASWGPVVLTSTLTGRGLQELERQLGSTTAVLAGPSGAGKSSIINALARAARERPSDASVSNVPEEQVVGEDGRALANPPPFTLADIRNAIPKDCFRKSAAKSLAYLGDLSITGMAVLAYKINSPWLWPLYWFAQGTMFWALFVVGHDCGHQSFSTSKRLNDALAWLGALAAGTWTWALGVLPMLNLYLAPYVWLLVTYLHHHGPSDPREEMPWYRGREWSYMRGGLTTIDRDYGLFNKVHHDIGTHVVHH

SEQ ID NO: 156 - protein, 315 aa, Prototheca moriformis
MFWALFVVGHDCGHQSFSTSKRLNDAVGLFVHSIIGVPYHGWRISHRTHHNNHGHVENDESWYPPTESGLKAMTDMGRQGRFHFPSMLFVYPFYLFWRSPGKTGSHFSPATDLFALWEAPLIRTSNACQLAWLGALAAGTWALGVLPMLNLYLAPYVISVAWLDLVTYLHHHGPSDPREEMPWYRGREWSYMRGGLTTIDRDYGLFNKVHHDIGTHVVHHLFPQIPHYNLCRATKAAKKVLGPYYREPERCPLGLLPVHLLAPLLRSLGQDHFVDDAGSVLFYRRAEGINPWIQKLLPWLGGARRGADAQRDAAQ

SEQ ID NO: 157 - protein, 448 aa, Camelina sativa
MANLVLSECGIRPLPRIYTTPRSNFVSNNNKPIFKFRPFTSYKTSSSPLACSRDGFGKNWSLNVSVPLTTTTPIVDESPLKEEEEEKQRFDPGAPPPFNLADIRAAIPKHCWVKNPWKSMSYVLRDVAIVFALAAGASYLNNWIVWPLYWLAQGTMFWALFVLGHDCGHGSFSNNPRLNNVVGHLLHSSILVPYHGWRISHRTHHQNHGHVENDESWHPMSEKIYQSLDKPTRFFRFTLPLVMLAYPFYLWARSPGKKGSHYHPESDLFLPKEKTDVLTSTACWTAMAALLICLNFVVGPVQMLKLYGIPYWINVMWLDFVTYLHHHGHEDKLPWYRGKEWSYLRGGLTTLDRDYGVINNIHHDIGTHVIHHLFPQIPHYHLVEATEAVKPVLGKYYREPDKSGPLPLHLLGILAKSIKEDHYVSDEGDVVYYKADPNMYGEIKVGAD

SEQ ID NO: 158 - protein, 368 aa, Prototheca moriformis; identical to SEQ ID NO: 77

SEQ ID NO: 159 - protein, 448 aa, Camelina sativa
MANLVLSECGIRPLPRIYTTPRSNFVSNNNKPIFKFRPLTSYKTSSPLFCSRDGFGRNWSLNVSVPLATTTPIVDESPLEEEEEEEKQRFDPGAPPPFNLADIRAAIPKHCWVKNPWKSMSYVLRDVAIVFALAAGAAYLNNWIVWPLYWLAQGTMFWALFVLGHDCGHGSFSNNPRLNNVVGHLLHSSILVPYHGWRISHRTHHQNHGHVENDESWHPMSEKIYQSLDKPTRFFRFTLPLVMLAYPFYLWARSPGKKGSHYHPESDLFLPKEKTDVLTSTACWTAMAALLICLNFVVGPVQMLKLYGIPYWINVMWLDFVTYLHHHGHEDKLPWYRGKEWSYLRGGLTTLDRDYGVINNIHHDIGTHVIHHLFPQIPHYHLVEATEAVKPVLGKYYREPDKSGPLPLHLLGILAKSIKEDHYVSDEGDVVYYKADPNMYGEIKVGAD

SEQ ID NO: 160 - DNA, 353 bp, Artificial Sequence
  source: /note="Description of Artificial Sequence: Synthetic polynucleotide"
actagtcattcggggcaacgaggtgggcccctcgcagcggctgacgatcacggcggtggccaacatcctgcaggaggcggcgggcaaccacgcggtggccatgtggggccggagcgtgtgtttgagggttttggttgcccgtattgaggtcctggtggcgcgcatgggggagaaggcgcctgtcccgctgacccccccggctaccctcccggcaccttccagggcgcgtacgggatccgctccggccccacatggccaccgcgtggttgcccgccgcctcctgcaggatgttggccaccgccgtgatcgtcagccgctgcgaggggcccacctcgttgccccgaatgaagctt

SEQ ID NO: 161 - DNA, 391 bp, Artificial Sequence
  source: /note="Description of Artificial Sequence: Synthetic polynucleotide"
actagtggagggtttcgcgacggacccggagctgcaggaggcgggtctcatctttgtgatgacgcgcatgcagatccagatgtaccgctacccgcgctggggcgacctgatgcaggtggagacctggttccagagtgtgtttgagggttttggttgcccgtattgaggtcctggtggcgcgcatgggggagaaggcgcctgtcccgctgacccccccggctaccctcccggcaccttccagggcgcgtacgggatcctctggaaccaggtctccacctgcatcaggtcgccccagcgcgggtagcggtacatctggatctgcatgcgcgtcatcacaaagatgagacccgcctcctgcagctccgggtccgtcgcgaaaccctccaagctt

SEQ ID NO: 162 - DNA, 393 bp, Artificial Sequence
  source: /note="Description of Artificial Sequence: Synthetic polynucleotide"
actagtcggcgggcaagctgggcgcgcagcgcgagtgggtgctgcgcgacaagctgaccggcgaggcgctgggcgcggccacctcgagctgggtcatgatcaacatccgcacgcgccggccgtgccgcatgccgggtgtgtttgagggttttggttgcccgtatcgaggtcctggtggcgcgcatgggggagaaggcgcctgtcccgctgacccccccggctaccctcccggcaccttccagggcgcgtacgggatccccggcatgcggcacggccggcgcgtgcggatgttgatcatgacccagctcgaggtggccgcgcccagcgcctcgccggtcagcttgtcgcgcagcacccactcgcgctgcgcgcccagcttgcccgccgaagctt

SEQ ID NO: 163 - DNA, 517 bp, Artificial Sequence
  source: /note="Description of Artificial Sequence: Synthetic polynucleotide"
actagtgtccgcgtcaagtcggccttcttcgcgcgcgagccgccgcgcctggcgctgccgcccgcggtcacgcgtgccaagctgcccaacatcgcgacgccggcgccgctgcgcgggcaccgccaggtcgcgcgccgcaccgacatggacatgaacgggcacgtgaacaacgtggcctacctggcctggtgcctggagtgtgtttgagggttttggttgcccgtattgaggtcctggtggcgcgcatgggggagaaggcgcctgtcccgctgacccccccggctaccctcccggcaccttccagggcgcgtacgggatcctccaggcaccaggccaggtaggccacgttgttcacgtgcccgttcatgtccatgtcggtgcggcgcgcgacctggcggtgcccgcgcagcggcgccggcgtcgcgatgttgggcagcttggcacgcgtgaccgcgggcggcagcgccaggcgcggcggctcgcgcgcgaagaaggccgacttgacgcggacaagctt

SEQ ID NO: 164 - DNA, 519 bp, Artificial Sequence
  source: /note="Description of Artificial Sequence: Synthetic polynucleotide"
actagtccgtgcccgagcacgtcttcagcgactaccacctctaccagatggagatcgacttcaaggccgagtgccacgcgggcgacgtcatctcctcccaggccgagcagatcccgccccaggaggcgctcacgcacaacggcgccggccgcaacccctcctgcttcgtccatagcattctgcgcgccgagaccgagcgtgtgtttgagggttttggttgcccgtatcgaggtcctggtggcgcgcatgggggagaaggcgcctgtcccgctgacccccccggctaccctcccggcaccttccagggcgcgtacgggatccgctcggtctcggcgcgcagaatgctatggacgaagcaggaggggttgcggccggcgccgttgtgcgtgagcgcctcctggggcgggatctgctcggcctgggaggagatgacgtcgcccgcgtggcactcggccttgaagtcgatctccatctggtagaggtggtagtcgctgaagacgtgctcgggcacggaagctt

SEQ ID NO: 165 - DNA, 415 bp, Artificial Sequence
  source: /note="Description of Artificial Sequence: Synthetic polynucleotide"
actagttcgtccgcgcgcgaaccacatggtcggcccccatcgacgcgcccgccgccaagccgcccaaggcgagccactgaggacagggtggttggctggatggggaaacgctggtcgcgggattcgatcctgctgcttatatcctcgtgtgtttgagggttttggttgcccgtattgaggtcctggtggcgcgcatgggggagaaggcgcctgtcccgctgacccccccggctaccctcccggcaccttccagggcgcgtacgggatccgaggatataagcagcaggatcgaatcccgcgaccagcgtttccccatccagccaaccaccctgtcctcagtggctcgccttgggcggcttggcggcgggcgcgtcgatgggggccgaccatgtggttcgcgcgcggacgaaagctt

SEQ ID NO: 166 - DNA, 2118 bp, Prototheca moriformis
atgtcgaaggagccgcagtctttctacaaggtggaggatggagtggccatcatcaccatctcctaccctcccatgaacgcccttcaccccacgctgatcaaggacatgttcaacaacgtccgtcgcgcccaggaggatgccagcgccaaggccatcgtcatcaccggtgccaacggtcgcttctgcgccggctttgacatcaaccagttccagaacaagagcgccggcgcsggcggcggcatcgacatgagcatcaacaacgcgtttgtsgagctcatcgagaacggscgcaagccgacggtggccgcgatcgagcggctggccctgggcggcgggtgcgagctggcgctggcctgcaacgcgcgcgtagcggcgcccggcaccatcatgggcctgcccgagctgacgctgggcattttgcccggctttggcggcacgcagcgcctgccgcgcgtggtgggccttgagaagggcctgtccatgatcctgaccagcaagcccatcaaggarcccgaggcgctcaagctgggcctgctggacgaggtggtgcccgcgccgcagctgctggcgcgcgccaaggcctttgcgctggagatcgtgmcsgggcagcgcccgcgcgtcaacgcgctccagcgcacggacaagctgcccgcgtacgcggacgcgctgcagatcatccagtttgcgcgcgagcagacggccaagcgcgcgcccaacctgcagcacccgctcttcacgctggacgcgatccaggccggcatcgagcacggcgggctcaagggcctgcgcgccgaggccgacgcctttgcgcgctcggcggcgctgcccacgcacgactcgctggtgcacgtcttcttcgcgcagcgctcgaccaagcgcgtgcgcggagtgaccgacgtcgggctcaagccacgtgcggtcaagaggatcgccgtgctgggcggcgggctcatgggctcgggcatcgccaccgcctcggcgctggcgggcgtsgaggtgctgctcaaggayatcaarsayaayttcctsgagggcggcctgggccgcatccgcgccaacctggcgtccaaggtcaagcggaagcagctctcgcagcaggcggcggacgccgcgatggcccgcgtcaagggcgtgctcacctacgacgacttcaagacsgtcgacatggtgatcgaggcggccatcgagaaggtggacctgaagcaggacatcttcgtggacctggtcagggccacgcgccccgactgcatcctggccaccaacacgtcgaccatcaacatcgagacggtgggcgccaagatcccgggcgacctgggccgcgtgatcggcgcgcactttttctcgccrgcgcacatcatgcccctgctggagatcgtgcgctcggacaagaccagcgcgcaggtcatcctggacacgctcgagtacggcagcaagatcaagaagacgcccgtcgtggtgggcaactgcacgggctttgcggtcaaccgcgtcttcttcccctactccatggccgcgaccattctcttggactcggggctcgacccctacgccatcgacgccgccatcacggcctttggcatgcccatggggcccttccgcctgggcgacctggtcggcctggacgtctcgctcttcgtgggcgcctcctacctgcaggactacggcgaccgcgtctaccgcggcgccatggtcccgctgctcaacgaggccggccgrctgggcgagaagaccggcgccggctggtacaagtttgacgaccgccgccgcgcgagcccggacccggcgctggcgccgctcctctcgcccaaggacatcgccgagttcatcttcttcccggtcgtcaacgaggcctgccgcgtcgtggccgagggcatcgtggacaagccctccgacctggacatcgccaccgtcatgtccatgggcttcccggcctaccgcggcggcatcctcttctacggcgacatcgtcggcgccaagtacgtcgtcgaccgtctcaacgcctgggccaagcagtaccccgcgcaggccggcttcttcaagccctgcgactacctcctscgcgccgcgcagaccggcaccaagctcgaggccggcaacaagcccgcctccaagatctga

SEQ ID NO: 167 - protein, 705 aa, Prototheca moriformis
  MOD_RES (77)..(77): Any amino acid
  MOD_RES (90)..(90): Any amino acid
  MOD_RES (96)..(96): Any amino acid
  MOD_RES (170)..(170): Any amino acid
  MOD_RES (201)..(201): Any amino acid
  MOD_RES (331)..(331): Any amino acid
  MOD_RES (337)..(337): Any amino acid
  MOD_RES (339)..(341): Any amino acid
  MOD_RES (343)..(343): Any amino acid
  MOD_RES (386)..(386): Any amino acid
  MOD_RES (449)..(449): Any amino acid
  MOD_RES (572)..(572): Any amino acid
  MOD_RES (686)..(686): Any amino acid
MSKEPQSFYKVEDGVAIITISYPPMNALHPTLIKDMFNNVRRAQEDASAKAIVITGANGRFCAGFDINQFQNKSAGXGGGIDMSINNAFXELIENXRKPTVAAIERLALGGGCELALACNARVAAPGTIMGLPELTLGILPGFGGTQRLPRVVGLEKGLSMILTSKPIKXPEALKLGLLDEVVPAPQLLARAKAFALEIVXGQRPRVNALQRTDKLPAYADALQIIQFAREQTAKRAPNLQHPLFTLDAIQAGIEHGGLKGLRAEADAFARSAALPTHDSLVHVFFAQRSTKRVRGVTDVGLKPRAVKRIAVLGGGLMGSGIATASALAGXEVLLKXIXXXFXEGGLGRIRANLASKVKRKQLSQQAADAAMARVKGVLTYDDFKXVDMVIEAAIEKVDLKQDIFVDLVRATRPDCILATNTSTINIETVGAKIPGDLGRVIGAHFFSXAHIMPLLEIVRSDKTSAQVILDTLEYGSKIKKTPVVVGNCTGFAVNRVFFPYSMAATILLDSGLDPYAIDAAITAFGMPMGPFRLGDLVGLDVSLFVGASYLQDYGDRVYRGAMVPLLNEAGXLGEKTGAGWYKFDDRRRASPDPALAPLLSPKDIAEFIFFPVVNEACRVVAEGIVDKPSDLDIATVMSMGFPAYRGGILFYGDIVGAKYVVDRLNAWAKQYPAQAGFFKPCDYLXRAAQTGTKLEAGNKPASKI

SEQ ID NO: 168 - DNA, 900 bp, Prototheca moriformis
atggacagggcgtggatgctggaccgcgagctggcggccaaccgcagccggggccttgactggggcgtggcgcgggcgctgtcggcctacgtctcggcctcgtactgcaacagcacgagcctggccgcgtggaactgcacgcgctgctcgccgcgcggcatcgacggcaacgccacgtggatrgaccccaactttgcgctggaggcgctggcctgggacgaggcctgggacctgctgggctacgtgggctggagcgaggagatgggcgcgaccgtgatcgccttccgcggcaccgactcgcacagctaccacaactgggtggccaacatgcgcacctggcgcaccgacctcaacctgaccatgcacggcgcgccggccaacgcgctcgtgcacggcggcttctggttctcctggaacgccagctccctggccacctccgtgaccgcggccgtgctgcgcctgcagcggcgccacggcgcgcacccggtctacgtgtcggggcactcgctgggcggcgcgctggccaccatctgcgcgctggagctgcgcaccatgcyccycktgcgcgacgtgcacctggtcacctttggcagcccgcgcgtgggcaacgccgtcttcgccggctggttcgagcggcgcatcacctcgcactggcgcttcacgcacaaccgcgaratcgtgcccagcgtgccgccgccctacatgggcttctggcacctggcgcgcgaggtctgggtgctggacaacgcgcgcctcaacccgctcgtcggcgtctgcgacgggacgggggaggacatgcagtgccacaactccatgtgccacctgggcctctgctcctccatcgcagaccacctcctctacatctckgagatgtacaccccgaggcccatgggctgctga

SEQ ID NO: 169 - protein, 299 aa, Prototheca moriformis
  MOD_RES (61)..(61): Any amino acid
  MOD_RES (186)..(188): Any amino acid
  MOD_RES (225)..(225): Any amino acid
  MOD_RES (289)..(289): Any amino acid
MDRAWMLDRELAANRSRGLDWGVARALSAYVSASYCNSTSLAAWNCTRCSPRGIDGNATWXDPNFALEALAWDEAWDLLGYVGWSEEMGATVIAFRGTDSHSYHNWVANMRTWRTDLNLTMHGAPANALVHGGFWFSWNASSLATSVTAAVLRLQRRHGAHPVYVSGHSLGGALATICALELRTMXXXRDVHLVTFGSPRVGNAVFAGWFERRITSHWRFTHNRXIVPSVPPPYMGFWHLAREVWVLDNARLNPLVGVCDGTGEDMQCHNSMCHLGLCSSIADHLLYIXEMYTPRPMGC

SEQ ID NO: 170 - DNA, 1398 bp, Prototheca moriformis
atgagtacccgcacggagcgcgacacgtttgggcccctggaggttccctccgacaggtactggggtgcccagacgcagcgttccctgcaaaacttcaagatcggcggcgcccccgagcgcatgccggagccggtggtgcgtgcctttggcgtgctcaagggcgcggcggccaaggtgaacatggacctgggcgtgctggacaagaccaagggcgaggcgatcgtggcggcggccaaggaggtggcggagggcaagctgacggaccacttccccctggtggtgtggcagacggggtctggcacgcagagcaacatgaacgccaacgaggtgattgccaaccgcgcgatcgagatgctgggcggcgagctgggcgacaagagcgtggtgcaccccaacgaccactgcaacaagggccagagctccaacgacaccttccccacggtgatgcacatcgcgggcgtgacggagatcagccgccgcctggtgcccgggttgcgccacctggcggaggcgctgcgcgccaaggagaaggagtttgccggcatcatcaagatcgggcgcacgcacacgcaggacgcgacgccgctgacgctgggccaggagttcagcggctacgcgacgcaggtcgagtacggcatcgagcgcgtgcaggccgcgctgccgcggctgagcatgctggcgcagggcggcaccgcggtgggcacggggctgaacgccaaggtcggctttgcggagaaggtggccgaggcggtggccgccgacacgggcctgcccttcaccaccgcgcccaacaagtttgaggcgctggccgcgcacgacgcggtggtggaggccagcggcgcgctcaacaccgtggctgtgagcctgatgaaggtcgccaacgacgtgcgcttcctgggcagcggcccgcgctgcggcctgggcgagctgagcctgcccgagaacgagccgggctcctccatcatgccgggcaaggtcaaccccacgcagtgtgaggcgctgaccatggtctgcgcgcaggtgatgggcaaccacgtggccgtcagcgtgggcggctccaacggccactttgagctcaacgtgttcaagcccatgatgatccgcaacctgctgcactcggcgcgcctgctcgccgacgccgccacctccttcaccgacaactgcgtcgtgggcatcagggccaacgagggccgcatcgcgcagctcctgcacgagtccctcatgctcgtcaccgcgctcaacaaccacatcggctacgacaaggccgccgccatcgccaagaaggcgcacaaggacggcagcacgctcaagcaggccgcgctcgagctcggctactgcaccgagcaggagtttgccgactgggtcaagcccgaggacatgctcgcgcccacgccctag

SEQ ID NO: 171 - protein, 465 aa, Prototheca moriformis
MSTRTERDTFGPLEVPSDRYWGAQTQRSLQNFKIGGAPERMPEPVVRAFGVLKGAAAKVNMDLGVLDKTKGEAIVAAAKEVAEGKLTDHFPLVVWQTGSGTQSNMNANEVIANRAIEMLGGELGDKSVVHPNDHCNKGQSSNDTFPTVMHIAGVTEISRRLVPGLRHLAEALRAKEKEFAGIIKIGRTHTQDATPLTLGQEFSGYATQVEYGIERVQAALPRLSMLAQGGTAVGTGLNAKVGFAEKVAEAVAADTGLPFTTAPNKFEALAAHDAVVEASGALNTVAVSLMKVANDVRFLGSGPRCGLGELSLPENEPGSSIMPGKVNPTQCEALTMVCAQVMGNHVAVSVGGSNGHFELNVFKPMMIRNLLHSARLLADAATSFTDNCVVGIRANEGRIAQLLHESLMLVTALNNHIGYDKAAAIAKKAHKDGSTLKQAALELGYCTEQEFADWVKPEDMLAPTP

SEQ ID NO: 172 - DNA, 1527 bp, Prototheca moriformis
atgtcgaccrtgtccgaatccaaggagatccargtccgggacgatgtcctgaagcggctcaargacccatccctcrtgcacaccgagtcgtacatcgggggcagctgggtgaacgctgccgatgacgacagggtggaggtgcacgacccggccagtggcgaggtgctcgcccgcgtgactcatgccaaggctgtggagaccaaggcggccatcgcsgaggcgtcctctgtgtttggcatgtggtcggcraagtcmggccwggagcggtccaacatcctrcgccgctggtttgagctgctgcgtgagaatcaggacgacatrgcgacgctcatgaccctggagagcggcaagcccctggsccaggccaaggccgagatcgcgagcggcctgggctctgtggagtggtttgcggaggaggccaagcgcgtggacggcgacattctgtgcagccccttccccaacaagcgctacctggtcatgcggcagcccatcggcgtggtgggcgccatcacgccctggaactttcccttttccatgatcacgcgcaagatctcgcccgccctggcggccggctgcacggtggtgctgaagccgagcgagctgacgccgctgacggcgctggcgatggccgagctgggggagcgggccggcatcccgctgggcgtgctcaacgtcgtcgtgggcgacgccaagtccatcggcgacgagctcatcaagagcgacgaggtgcgcaaggtcgccttcaccggctccacccgcatcggcaagatcctcatggccggcgcggccaacacggtcaagaaggtctccatggagctgggcgggaacgcgccctacatcgtcttcccagacgccgacctcaaggcggcggcctcccaggcggcggcgtcctcccaccgcaacgccgggcagacgtgcatctgcaccaaccgggtgcttgtccacgaaagcgtgcacgacgagtttgtcaaggagctggtggcagcggtgcaggaattcaggctgggtcacggcaccgaccccagcaccacgcacggcccgctcatccagccgggggccgtcgacaaggtggaggagaaggtgcaggacgcggtggccaagggcgcgacggtgcagaccgggggcaagcgccccacgttcagcgagaacagccccctcaacaacggcttcttcttcgagcccaccgtcatctccaatgcgaccatcgacatgaaggtgttcagggaggagatcttcgggcccgtgacccccgtgttcaagttttcctcggacgaggaggccgtcaagctggcgaacaacaccgagtacgggctggctgcctacctcttcaccaaggacctcgcgcgcgcctggaaggtgtccgaggcgctcgagttcggcatggtcggcgtgaacgacgtgctcatcaccagctacgtctcgccctttggcggcgtcaagcagtcgggcctsggccgcgaggagtccaagtacggcatcgargagtacctgcagatgaagtcggtgtgcatgaacctggggtactga

SEQ ID NO: 173 - protein, 508 aa, Prototheca moriformis
  MOD_RES (4)..(4): Any amino acid
  MOD_RES (11)..(11): Any amino acid
  MOD_RES (21)..(21): Any amino acid
  MOD_RES (26)..(26): Any amino acid
  MOD_RES (72)..(72): Any amino acid
  MOD_RES (83)..(83): Any amino acid
  MOD_RES (85)..(85): Any amino acid
  MOD_RES (87)..(87): Any amino acid
  MOD_RES (93)..(93): Any amino acid
  MOD_RES (107)..(107): Any amino acid
  MOD_RES (120)..(120): Any amino acid
  MOD_RES (484)..(484): Any amino acid
  MOD_RES (494)..(494): Any amino acid
MSTXSESKEIXVRDDVLKRLXDPSLXHTESYIGGSWVNAADDDRVEVHDPASGEVLARVTHAKAVETKAAIXEASSVFGMWSXKXGXERSNIXRRWFELLRENQDDXATLMTLESGKPLXQAKAEIASGLGSVEWFAEEAKRVDGDILCSPFPNKRYLVMRQPIGVVGAITPWNFPFSMITRKISPALAAGCTVVLKPSELTPLTALAMAELGERAGIPLGVLNVVVGDAKSIGDELIKSDEVRKVAFTGSTRIGKILMAGAANTVKKVSMELGGNAPYIVFPDADLKAAASQAAASSHRNAGQTCICTNRVLVHESVHDEFVKELVAAVQEFRLGHGTDPSTTHGPLIQPGAVDKVEEKVQDAVAKGATVQTGGKRPTFSENSPLNNGFFFEPTVISNATIDMKVFREEIFGPVTPVFKFSSDEEAVKLANNTEYGLAAYLFTKDLARAWKVSEALEFGMVGVNDVLITSYVSPFGGVKQSGXGREESKYGIXEYLQMKSVCMNLGY

SEQ ID NO: 174 - DNA, 1083 bp, Prototheca moriformis
atggccgctacgctcagcatgaagtccgtggcgctgcagcgtcccaccaggtgtgggcctgcaccccgcacagtggtccgggcgccggccatgcgcgtccgggctgcagccaccgccgccccggaggcccccgccgcggaccacgcgtttgacgactaccagccccgcacggccatcctcttccctgggcagggcgcgcagagcgtgggcatggcgggcgagctrgtcaagtcggtgcccaaggcggcscacatgtttgacgaggcctcygccatcctkggctacgacctgctcaagacstgcgtggagggccccaaggagcgcctggacagcacggtggtgagccagccggccatctacgtgacgagcctggcggccgtcgagaagctgcgcgccgacgagggcgacgaggcggtggcggccgtcgacgtggcggcgggcctgtccctgggcgagtacacggccctggcctttgccggcgccttcagcttcgaggacgggctgcgactggtcgcgctgcgcggcgccagcatgcagcgcgcggccgacgcggccgccagcggcatggtctccgtcatcggcctctcggccgccgcgaccgaggcgctgtgcgaggcggccaacgccgaggtcccgcccgagcaggccgtgcgcgtggccaactacctctgcaacggcaactacgccgtgagcggcggcctygagggctgcgcggccgtcgagcgcctrgccaaggcgcacaargcgcgcatgaccgtgcgcctggccgtggccggcgccttccacacggcctacatgcagccggccgtggaggcgctgaccgcggccctggccagcacggacatcgccgcrccgcgcatccccgtcgtctccaacgtcgacgcygcgccgcacgccgacccggacaccatccgcgccctgctggcccgccaggtcaccgcgcccgtgcagtgggagaccacgctcaacaccctgctctcccgcggcctccagcgctcctacgaggtcggcccgggcaaggtcatcgccggcatcatcaagcgcgtcaacaagaagcacccggtgaccaacatcactgcctga

SEQ ID NO: 175 - protein, 360 aa, Prototheca moriformis
  MOD_RES (75)..(75): Any amino acid
  MOD_RES (83)..(83): Any amino acid
  MOD_RES (90)..(90): Any amino acid
  MOD_RES (93)..(93): Any amino acid
  MOD_RES (100)..(100): Any amino acid
  MOD_RES (234)..(234): Any amino acid
  MOD_RES (243)..(243): Any amino acid
  MOD_RES (248)..(248): Any amino acid
  MOD_RES (284)..(284): Any amino acid
  MOD_RES (295)..(295): Any amino acid
MAATLSMKSVALQRPTRCGPAPRTVVRAPAMRVRAAATAAPEAPAADHAFDDYQPRTAILFPGQGAQSVGMAGEXVKSVPKAXHMFDEAXAIXGYDLLKXCVEGPKERLDSTVVSQPAIYVTSLAAVEKLRADEGDEAVAAVDVAAGLSLGEYTALAFAGAFSFEDGLRLVALRGASMQRAADAAASGMVSVIGLSAAATEALCEAANAEVPPEQAVRVANYLCNGNYAVSGGXEGCAAVERXAKAHXARMTVRLAVAGAFHTAYMQPAVEALTAALASTDIAXPRIPVVSNVDXAPHADPDTIRALLARQVTAPVQWETTLNTLLSRGLQRSYEVGPGKVIAGIIKRVNKKHPVTNITA

SEQ ID NO: 176 - DNA, 1407 bp, Prototheca moriformis
atgcagttgcagcgagcgctcacggtgcgcctgcggaggaggggctggcgtcgcaactcgttcaacaatgtggacgccgtctcgcccaagcttgtgcgcaagwcatccaatgccgggcagcagacacagtcggaggacaggtttaggtccttcaaggtcaggaccctgtccacaatcgtcctcatcgccaccttcatcggcatcatcgccacggggcacgtgcccctcatgctcatgatcctgggcatccagtttctgatggtcmgggagctstttgcgctggcgagggtsgcgccccaggagcgcaaggtccccggcttccgggcgcagcagtggtactttttcttcgtggccgccttttacctgtacatccgcttcatcaagaccaacctcacggtggagctctcctcctcggcgcaaacggcggccatgtttggctggatcatccgccaccacacgctcctctccttcgccctctacacggccgggttcgtgtcgttcgtgctgcgcctgaaraagggactctacagytaccagttccagcagtacgcctggacgcacatgatcctcatggtcatcttcctgccttcgtccttctttgtgtacaacctcttcgaggggctgatctggttcctgctccccgcggccttggtcgtggtcaacgacatygcggcctacctggcaggctttttctttgggaggacccckctgatcaagctgtctcccaagaagacgtgggagggcttyatcggcggcctggcgggcacggtggtggtgggctggtatctggccaagttgctgtctcaattcaactggttcatctgtcctcggcgggacctgtccatcatccagcctctgcactgtgacagcaagctggacatctaccagccagagacattctacctgacagatgtcttgacgctcttgccggccgacctggccaccgcggtggtcacggggctcacccgcctctcgcccggctggcaggaagctgcgcggcaggtgtccctgacctgcctgcccatgcagctgcacgcggtcgtgctggcgacgtttgcgagcctgatcgcaccctttggcggcttcttcgcctcgggcttcaagcgcggcttcaagatcaaggactttggcgacagcatccccggccacggcggcatgaccgaccgcatggactgccaggtggtcatgtcggtcttctcctwcatctacctcacgtcctacgtggcgcccgcgggccccaccgtcggcagcgtcctggcggccgccgtgaagctggcgccgctggarcagctggacctgtttgagcgcatggccaacgtgctggtgggctccaaggtcctgtccccggccatcggcgagaccatcgccgccaccgcgcgccgcaagctccagacgggcgccctttag

SEQ ID NO: 177 - protein, 468 aa, Prototheca moriformis
  MOD_RES (35)..(35): Any amino acid
  MOD_RES (89)..(89): Any amino acid
  MOD_RES (91)..(91): Any amino acid
  MOD_RES (97)..(97): Any amino acid
  MOD_RES (172)..(172): Any amino acid
  MOD_RES (177)..(177): Any amino acid
  MOD_RES (223)..(223): Any amino acid
  MOD_RES (236)..(236): Any amino acid
  MOD_RES (249)..(249): Any amino acid
  MOD_RES (401)..(401): Any amino acid
  MOD_RES (429)..(429): Any amino acid
MQLQRALTVRLRRRGWRRNSFNNVDAVSPKLVRKXSNAGQQTQSEDRFRSFKVRTLSTIVLIATFIGIIATGHVPLMLMILGIQFLMVXEXFALARXAPQERKVPGFRAQQWYFFFVAAFYLYIRFIKTNLTVELSSSAQTAAMFGWIIRHHTLLSFALYTAGFVSFVLRLXKGLYXYQFQQYAWTHMILMVIFLPSSFFVYNLFEGLIWFLLPAALVVVNDXAAYLAGFFFGRTXLIKLSPKKTWEGXIGGLAGTVVVGWYLAKLLSQFNWFICPRRDLSIIQPLHCDSKLDIYQPETFYLTDVLTLLPADLATAVVTGLTRLSPGWQEAARQVSLTCLPMQLHAVVLATFASLIAPFGGFFASGFKRGFKIKDFGDSIPGHGGMTDRMDCQVVMSVFSXIYLTSYVAPAGPTVGSVLAAAVKLAPLXQLDLFERMANVLVGSKVLSPAIGETIAATARRKLQTGAL

SEQ ID NO: 178 - DNA, 741 bp, Prototheca moriformis
atgttgctgccctttgagctcatgttcgaccgctacaggcggcatattctgaacaagatcaaccagttttgggcgcgggtggccgcgtggccgttttacggcgtcatcgtggayggccgcgagaacctgccrcctcccggcgaagccgtgatctatgtcgccaaccaccagagctacctggacatcacggcgctgctgcacatgggcgcmgacttcaagtacgtctccaaggccgcccttttcatggtgcctttcctgggctgggccatgttcctcacagggcacgtccggctcgtrcgagacgaccgcgagtcgcagcaaaaatgcttgaaacagtgcgacaccctcctccgcaacggcacctccgtcgcctttttccccgagggcacgcggagccaggatggsaagatgcatgccttcaaaaagggcgcctttatggtggcggccagggcgcgggtgaacgtcgtgcccgtcacgatcgagggctccggcgacctgatgcccagccggaacgagtacctgatgacctacggcgacattcgggtgcgcatccacccgcccatcgcctcgcgcggccggtcgctggagtcgctgcgcctggcggcgcaggaggcggtggcgtccgsgctgcccgagcgcctgatcggggacgacatccggccgcgckagctggaggcgcccacgccggcgccgacagaggcgacagaggcgagagaggcgccgctgcacgaacagcgctga

SEQ ID NO: 179 - protein, 246 aa, Prototheca moriformis
  MOD_RES (38)..(38): Any amino acid
  MOD_RES (44)..(44): Any amino acid
  MOD_RES (70)..(70): Any amino acid
  MOD_RES (99)..(99): Any amino acid
  MOD_RES (135)..(135): Any amino acid
  MOD_RES (209)..(209): Any amino acid
  MOD_RES (223)..(223): Any amino acid
MLLPFELMFDRYRRHILNKINQFWARVAAWPFYGVIVXGRENLXPPGEAVIYVANHQSYLDITALLHMGXDFKYVSKAALFMVPFLGWAMFLTGHVRLXRDDRESQQKCLKQCDTLLRNGTSVAFFPEGTRSQDXKMHAFKKGAFMVAARARVNVVPVTIEGSGDLMPSRNEYLMTYGDIRVRIHPPIASRGRSLESLRLAAQEAVASXLPERLIGDDIRPRXLEAPTPAPTEATEAREAPLHEQR

SEQ ID NO: 180 - DNA, 1248 bp, Prototheca moriformis
atgtccaaggcttcttccaccatcgtctccgctcctgcgggcccgcaggagtcgcccgctcgctacagtaccgagtcgaccgagatccggagctcycccctgtttggacgccttttggacgtcaagagcaacgttgtcgcccttggagggcacagaggyctgggcgccaactactgggacaagccggcgcagggctcgctccgccgcttcagcgtgcgagagaacaccatcccctccttcctcaagtcggttgcggccggcgccagcttcatcgagtttgacgtgcaggtcacgcgggacggcgtgcctgtgatctggcacgacaactatgtggtaacgggcacgcccgattgctttgtgaaccggctgatcagcgacctgagctacgacgagtttgtgagcctggtgccggccagcgccgayctggcgcgccagaaggcgggccaggtggcgggcctgcgcgcggaggacgtggagggcagcacgcgcttgctgcgcgcgctggtgggcgacgagccrgtggacccsggcaacccgaccgtggcggggtgggaggccgactcggagtcgcgcctgcccagcttggccgagctgttcgcagccatcccctcgcacgtcgcctttgacatcgagatcaaggtcgcgaccagcagccgcacggtgcacacgccgctgcgcgaggtggagcgcctgctgtccgccatcctgacggccgtggacgcggcgcaggaggcggccgaggccgcgggccgcccgcggcgcgagatcctgtacagctccttcgacccggacgtctgcgcggagctggcgcagcgccgccccgacgcggccgtcatgttcctgtcgggcggcgggcagtatgcgcactcggacccccgccgcacctcctttgcggccgccatcgactgggcgcgcggcgccaacctggccggcgtgatcttccacgcgggccgcctgcgcaccgcgctcgaggcggtcgtgcgcgacgcgctggccgcgggcctccaggtcatgacctacggccaggacaacaccgacgccggctacgtggaggagcagtacgctcgcggcgtccgcggcgtcatcgtggacgacgtcagctcggtcgtggacgcgctcgtccagcgcggcgtcgcgcggcgctcggtcgcgctggccgccggcgagggcaagcagaacggcgtgccggactcggagaaggtgaaggcctcgcccgcgcgcctgccggccctggccgccgcctgctaa

SEQ ID NO: 181 - protein, 415 aa, Prototheca moriformis
  MOD_RES (32)..(32): Any amino acid
  MOD_RES (53)..(53): Any amino acid
  MOD_RES (141)..(141): Any amino acid
  MOD_RES (173)..(173): Any amino acid
  MOD_RES (176)..(176): Any amino acid
MSKASSTIVSAPAGPQESPARYSTESTEIRSXPLFGRLLDVKSNVVALGGHRXLGANYWDKPAQGSLRRFSVRENTIPSFLKSVAAGASFIEFDVQVTRDGVPVIWHDNYVVTGTPDCFVNRLISDLSYDEFVSLVPASAXLARQKAGQVAGLRAEDVEGSTRLLRALVGDEXVDXGNPTVAGWEADSESRLPSLAELFAAIPSHVAFDIEIKVATSSRTVHTPLREVERLLSAILTAVDAAQEAAEAAGRPRREILYSSFDPDVCAELAQRRPDAAVMFLSGGGQYAHSDPRRTSFAAAIDWARGANLAGVIFHAGRLRTALEAVVRDALAAGLQVMTYGQDNTDAGYVEEQYARGVRGVIVDDVSSVVDALVQRGVARRSVALAAGEGKQNGVPDSEKVKASPARLPALAAAC

SEQ ID NO: 182 - DNA, 1011 bp, Prototheca moriformis
atgacggaggccgtctcggacagggatgctctscaaccggagctgggcttcgtscagaagctgggcatgtactttgcgctgccagtttggatgataggcctcgtggtgggcgccctctggctmcccgtgaccgtggtgtgcctcttcatcttcccaaagctggcgacattgagtctggggctgctgctggtggcgatgctcacccccctgtcgctgccctgccccaagccgctggcccgcttcctggcctactgcaccaccgccgcggccgagtactaccccgtgcgsttcatctacgaggacaaggaggagatggaggccaccaagggccccgtcatcatcgggtacgagccccacagcgtcatgccrcaggccatctccatgttrgccgagtacccgcaccccgccgtggtcggcccgctgcgcaaggcgcgcgtgctggcktccagcaccggcttctggacgccgggcatgcggcacctgtggtggtggctgggcacgcgccccgtgagcaagccctccttcctcgcccagctgcgcaagcagcgctccgtcgccctctgcccgggcggcgtgcaggagtgcctctacatggcccacggcaaggaggtcgtctacctccgcaaacgctttggatttgtcaaactggccatccagaccggcaccccgctggtcccggtcttcgcctttggccagacggagacctacacctttgtgcggcccttcatcgactgggagacgcgcctgctgccgcggtccaagtacttttcgctggtgcgccgcatgggctacgtgcccatgatcttcttcggccacctgggcacggccatgcccaagcgcgtgcccatccacatcgtcatcggccggcccatcgaggtgccgcagcaggacgagcccgacccggccacggtgcagcagtacctcgacaagttcatcgacgccatgcaggcaatgtttgagaagcacaaggccgacgccggctaccccaacctgacgctcgagatccactga

SEQ ID NO: 183 - protein, 336 aa, Prototheca moriformis
  MOD_RES (11)..(11): Any amino acid
  MOD_RES (18)..(18): Any amino acid
  MOD_RES (41)..(41): Any amino acid
  MOD_RES (96)..(96): Any amino acid
  MOD_RES (123)..(123): Any amino acid
  MOD_RES (129)..(129): Any amino acid
  MOD_RES (148)..(148): Any amino acid
MTEAVSDRDAXQPELGFXQKLGMYFALPVWMIGLVVGALWXPVTVVCLFIFPKLATLSLGLLLVAMLTPLSLPCPKPLARFLAYCTTAAAEYYPVXFIYEDKEEMEATKGPVIIGYEPHSVMXQAISMXAEYPHPAVVGPLRKARVLXSSTGFWTPGMRHLWWWLGTRPVSKPSFLAQLRKQRSVALCPGGVQECLYMAHGKEVVYLRKRFGFVKLAIQTGTPLVPVFAFGQTETYTFVRPFIDWETRLLPRSKYFSLVRRMGYVPMIFFGHLGTAMPKRVPIHIVIGRPIEVPQQDEPDPATVQQYLDKFIDAMQAMFEKHKADAGYPNLTLEIH

SEQ ID NO: 184 - DNA, 1020 bp, Prototheca moriformis
atggacgctcaaggatacctcgtsaaggcgtccgagtckccagcatggacgtacctggtsctgctggcctcggcgctgttcgccatcaaggtcgtgggattygtcctgacggttctgggcgggctgtacgcccactttctccgcaagggaaagaaactgcggcgatatggggactgggcagtggtgactggcgcgacagacggcatcggcaaggcctacgctgaggccctcgcgaagcaaaagctgcgcctggtgctgatctcgcggacagagtcgcgtcttgaggaggaggcccggctgctgcaggacaagtttggcgtggaggtgaagatcatccccgccgacctcagctcctcggacgaggccgtgtttgcccggatcggcaagggcctggagggcctggacattggcatcctggtgaacaatgccggcatgtcctacccccacccggagtacctgcacctggtcgacgacgagaccctggccaacctcatcaatctcaacgtcgccaccccgaccaagctgtgcaagatggtgctgggcggcatgaaggagcgcggccgcggcytggtggtcaacgtyggsagcggcgtcgcgagcgccattccctcggggcccctcctctcggcctacaccgccagcaaggcgtacgtggaccagctgagcgagtcgctgaacgacgagtacaaggagtttggcgtgcaggtgcagaaccaggcgccgctgtttgtggccaccaagatgtccaagatccgcaagccgcgcatcgacgcgcccacgcccggcacctgggccgccrccgcsgtycgcgccatgggrttcgagacgctgtccttcccctactggttccacgcgctgcaggcggccgtcgtggagcgcctgccggaggccatgatccgctaccaggtcatgcagatccaccgcagcctgcgccgcgcggcctacaagaagaaggcgcgcgcgtccgccgccgccctggcggacgagggcgtctccgcggagcccaagaaggacctgtga

SEQ ID NO: 185 - protein, 339 aa, Prototheca moriformis
  MOD_RES (8)..(8): Any amino acid
  MOD_RES (13)..(13): Any amino acid
  MOD_RES (20)..(20): Any amino acid
  MOD_RES (34)..(34): Any amino acid
  MOD_RES (190)..(190): Any amino acid
  MOD_RES (194)..(195): Any amino acid
  MOD_RES (267)..(269): Any amino acid
  MOD_RES (273)..(273): Any amino acid
MDAQGYLXKASEXPAWTYLXLLASALFAIKVVGXVLTVLGGLYAHFLRKGKKLRRYGDWAVVTGATDGIGKAYAEALAKQKLRLVLISRTESRLEEEARLLQDKFGVEVKIIPADLSSSDEAVFARIGKGLEGLDIGILVNNAGMSYPHPEYLHLVDDETLANLINLNVATPTKLCKMVLGGMKERGRGXVVNXXSGVASAIPSGPLLSAYTASKAYVDQLSESLNDEYKEFGVQVQNQAPLFVATKMSKIRKPRIDAPTPGTWAAXXXRAMXFETLSFPYWFHALQAAVVERLPEAMIRYQVMQIHRSLRRAAYKKKARASAAALADEGVSAEPKKDL

SEQ ID NO: 186 - DNA, 1197 bp, Prototheca moriformis
atggagaggaggacctcggccaacccctccgtgggtcttagcagcttaaagcacgttccgttgagcgcggtggacctccccaatttcgagtccgttcccaagggtgcggccagccccgatgtccatcgtcagatagaggagctggtggacaaggcacgcgcagatcggtcaccggcatcgttgtcgctcctagccgatgtgctggacatcagcgggccgctgcaggacgcggcctcggcgatggtggacgactccttcctgcgctgcttcacctccaccatggacgagccctggaactggaacttttacctgttcccgctctgggcgctcggcgtcgtcgtrcgcaacrtgatcctgttccccctgcgcctcctcaccatcgtgctggggacgctgctcttcgtgctggcctttgccgtgacgggcttcctccccaaggagaggcggctcgcggccgagcagcggtgcgtccagttcatggcgcaggcattcgtggcctcctggacaggcgtgatccggtaccacggcccccgccccgtggcggcgcccaaccgcgtgtgggtcgccaaccacacgtccatgatcgactacgcggtgctgtgcgcctactgcccgtttgcggccatcatgcagctgcacccsggctgggtgggcgtcttrcagacgcgctacctggcctcgctgggctgcctctggttcaaccgcacgcaggccaaggaccgcacgctcgtggccaagcgcatgcgcgagcacgtggccagcgcgaccagcacgccgctgctcatcttccccgagggcacctgcgtcaacaacgagtactgcgtcatgttccgcaagggcgccttrgacctgggcgccaccgtctgccccgtsgccatcaagtacaacaagatcttcgtcgacgccttttggaacagcaagcgccagtccttctccgcgcacctcatgaagatcatgcgctcgtgggccctcgtctgcgacgtctacttcctggagccccagacgcggagggagggcgagtcggtcgaggcgtttgcgaaccgcgtgcaggcgctgatcgcgcaaaaggcccggctgaaggtcgcgccctgggacggctacctcaagtactacaacctggccgagaagcacccggacctgatcgagaaccagcggcgccagtacagcgccgtcatcaaaaagtargccgaggastga

SEQ ID NO: 187 - protein, 398 aa, Prototheca moriformis
  MOD_RES (114)..(114): Any amino acid
  MOD_RES (117)..(117): Any amino acid
  MOD_RES (214)..(214): Any amino acid
  MOD_RES (220)..(220): Any amino acid
  MOD_RES (282)..(282): Any amino acid
  MOD_RES (291)..(291): Any amino acid
  MOD_RES (395)..(395): Any amino acid
  MOD_RES (398)..(398): Any amino acid
MERRTSANPSVGLSSLKHVPLSAVDLPNFESVPKGAASPDVHRQIEELVDKARADRSPASLSLLADVLDISGPLQDAASAMVDDSFLRCFTSTMDEPWNWNFYLFPLWALGVVXRNXILFPLRLLTIVLGTLLFVLAFAVTGFLPKERRLAAEQRCVQFMAQAFVASWTGVIRYHGPRPVAAPNRVWVANHTSMIDYAVLCAYCPFAAIMQLHXGWVGVXQTRYLASLGCLWFNRTQAKDRTLVAKRMREHVASATSTPLLIFPEGTCVNNEYCVMFRKGAXDLGATVCPXAIKYNKIFVDAFWNSKRQSFSAHLMKIMRSWALVCDVYFLEPQTRREGESVEAFANRVQALIAQKARLKVAPWDGYLKYYNLAEKHPDLIENQRRQYSAVIKKXAEX

SEQ ID NO: 188 - DNA, 1041 bp, Prototheca moriformis
atgcccctcccgaacgccatagagctcccgggcgccgatcccaaatcgagctcggtgtacagctttcaggggcacagcacgaatctgcaagtcaacgccaggggcgtcgckcagtccgtgtacgacgargtcgaccccgcaacgtacctggggcccagagggcggcaggagacggtcgtgaacgcgcagggcctcacgctgcgggtttactactggccggcagagcagcccaaggcaatcttgcagtttgtgcacggacatggcgcgcacgcactgtttgaactcttggamatcgatgaggctggaaagccgccaacgtacgctggctgggtggccaagctcaatgccgcgggcatcagcgtggtcgcccacgacaatcagggctgcgggcgctcagaggcggcgcggggcctgcgcttctacatcgagtcctttgacgattttgtcaaggacgtgttgcttctccgcagggagctggtgaagcaagagggctttgacagcytgccggtyttcctggggggcatctcactwggyggctgcatagcgctcacctccctgctcgaagagcccgaccartaccrcgggctgtgcctgctggcgcccatgatctcgctscaaaaggtgtcccgcaagggcctyaayccctacctgcggccgctggcggcgctgctgagccgcgtcgtcccgtgggcgcccatcatcgcgaccgaccgcacctccaactctgtyctccagctgcagtgggatgcagacccactgaccgcgcacatgaacacgcgcgtccgcaacgccaacgagtacctctgcgcgacggagcgcgtgacggcccggctgrgcrcgytgcagaagcccttcatcgtcttccactcggagaacgacacaatgtgcgacgcggacggctccaagcagctctacgccgaggcacagtccagcgacaagaccatccgctttgtcaacagcatgtggcacgtgctggtcaaggarccgggcaacgaggaggtcytgcagastctggtgcagtggatcctcgamcgggcgtga

SEQ ID NO: 189 - protein, 346 aa, Prototheca moriformis
  MOD_RES (37)..(37): Any amino acid
  MOD_RES (43)..(43): Any amino acid
  MOD_RES (97)..(97): Any amino acid
  MOD_RES (168)..(168): Any amino acid
  MOD_RES (170)..(170): Any amino acid
  MOD_RES (177)..(178): Any amino acid
  MOD_RES (192)..(192): Any amino acid
  MOD_RES (194)..(194): Any amino acid
  MOD_RES (205)..(205): Any amino acid
  MOD_RES (213)..(214): Any amino acid
  MOD_RES (243)..(243): Any amino acid
  MOD_RES (279)..(281): Any amino acid
  MOD_RES (328)..(328): Any amino acid
  MOD_RES (335)..(335): Any amino acid
  MOD_RES (337)..(337): Any amino acid
  MOD_RES (344)..(344): Any amino acid
MPLPNAIELPGADPKSSSVYSFQGHSTNLQVNARGVXQSVYDXVDPATYLGPRGRQETVVNAQGLTLRVYYWPAEQPKAILQFVHGHGAHALFELLXIDEAGKPPTYAGWVAKLNAAGISVVAHDNQGCGRSEAARGLRFYIESFDDFVKDVLLLRRELVKQEGFDSXPXFLGGISXXGCIALTSLLEEPDXYXGLCLLAPMISXQKVSRKGXXPYLRPLAALLSRVVPWAPIIATDRTSNSXLQLQWDADPLTAHMNTRVRNANEYLCATERVTARLXXXQKPFIVFHSENDTMCDADGSKQLYAEAQSSDKTIRFVNSMWHVLVKXPGNEEVXQXLVQWILXRA

SEQ ID NO: 190 - DNA, 1356 bp, Prototheca moriformis
atggatgctcagaagcgagtccaagtcttgtccggtcacttgtccgaaactgcgggcgatgccgtggcggtctgccgggcggacaccctggccgcgggggtgagccccaagttcgaccaggcccaggacatgaccgtgtttcccccggccaaccacgatgcgctcttcctcagcgacctgctgactcccgaggaaaaggatgtgcaaatgcgcgtccgcaagtttgcggaggagaccgttgcgcccaacgtgattccctactgggaaaaggccgagttcccgcacgcgctgcgkcccgagtttggraagctgggcatcggcggcgggcacaacaaggggcacggctgccccggcctgagcaccatggcggcggcstcggcggtggtggagctggcgcgcgtggacggctccatgagcacytttttcctggtscacacctacctgggcgcgatgacggtgggcctgctgggctcsgaggcgcagaagcgggagctgctgcccggcttccacrcctttgacaaggtgtgcagctgggcgctgacggagccgagcaacgggtcggacgcctcggcgctgaccacgaccgcgcgscgcgtggagggcggctggctgctcmgcgggcgcaagcgctggatcggcaacgcgacctttgcggacatcatcatcgtctgggcgcgcagcagcgtgacggggcaggtcaacgccttcatcgtgcgcaggggcgcgccggggctgaccacgagcaagatcgagaacaaratcgcgctgcgctgcgtgcagaacgccgacatcctgatggaggacgtgtttgtccccgacgcggaccgcctgcccggsgtcaactcgttcgcggacgcggcgggcatgctggccatgtcgcgctgcctggtggcctggcagccggtgggcctggtggtgggygtgtacgacatggtgctgcgctacacgcagcagcgccgccagtttggcgcgccgctggccgccttccagctggtgcaggagcggctggcgcgcatgctgggcaccatccaggccatgtacctcatgtgcgcgcgcctgagcaagctctacgacgagggccgcatgacgcacgagcaggccagcctggtcaaggcctggaccaccgcgcgctcgcgcgaggtcgtcgcgctcggccgcgagtgcctgggcggcaacggcatcgtcggcgagttcctcgtggccaaggcctttgtcgacgccgaggcgtattacacgtatgaagggacctacgacgtcaacgtgctcgtcgccgcgcgcggcctcaccggctacgccgccttcaagacgcccggccgcggcggcaagaaggacgmcgccgcgaagaaggagcactga

SEQ ID NO: 191 - protein, 451 aa, Prototheca moriformis
  MOD_RES (98)..(98): Any amino acid
  MOD_RES (102)..(102): Any amino acid
  MOD_RES (125)..(125): Any amino acid
  MOD_RES (140)..(140): Any amino acid
  MOD_RES (144)..(144): Any amino acid
  MOD_RES (158)..(158): Any amino acid
  MOD_RES (171)..(171): Any amino acid
  MOD_RES (197)..(197): Any amino acid
  MOD_RES (206)..(206): Any amino acid
  MOD_RES (253)..(253): Any amino acid
  MOD_RES (279)..(279): Any amino acid
  MOD_RES (307)..(307): Any amino acid
  MOD_RES (445)..(445): Any amino acid
MDAQKRVQVLSGHLSETAGDAVAVCRADTLAAGVSPKFDQAQDMTVFPPANHDALFLSDLLTPEEKDVQMRVRKFAEETVAPNVIPYWEKAEFPHALXPEFXKLGIGGGHNKGHGCPGLSTMAAXSAVVELARVDGSMSXFFLXHTYLGAMTVGLLGXEAQKRELLPGFHXFDKVCSWALTEPSNGSDASALTTTAXRVEGGWLLXGRKRWIGNATFADIIIVWARSSVTGQVNAFIVRRGAPGLTTSKIENXIALRCVQNADILMEDVFVPDADRLPXVNSFADAAGMLAMSRCLVAWQPVGLVVXVYDMVLRYTQQRRQFGAPLAAFQLVQERLARMLGTIQAMYLMCARLSKLYDEGRMTHEQASLVKAWTTARSREVVALGRECLGGNGIVGEFLVAKAFVDAEAYYTYEGTYDVNVLVAARGLTGYAAFKTPGRGGKKDXAAKKEH

SEQ ID NO: 192 - DNA, 828 bp, Prototheca moriformis
atggcgccgagcccgaccttcaaggcactcaaggtctggatggacgacgatctggtgggacacatccagctcaatcgtcctcaagccgccaattcgatgaatgaggagatgtggacggagctgccgcaggccacagcgtggttggagagccagtctgcgcgcgtcatwctggtcacgggcgcsggcaagaacttttgcgcgggcatcgacgtggcgagcctcggctcgaccgtgctctcccacgkcgccggctgcgcggcgcgctcggcctaccgcttccgcmcgggcctgaccamsctgcaggaggccatgacygccctggagcgcgtgcgctgccccaccgtggcgctggtgcacggycactgtgtsggggccggcgtcgacctcatcacggcctgcgacatccgktttgccacggcggacgccaagctstgcgtcaaggaggtcgarctggccgtgatcgccgacatgggcacgctccagcgcctcccaggcatcgtgggscakggccacgcccgcgagctgtcgctgacggcccgggtcttctccggggaggaagcaaagcagatgggtctcgccaccgcggcgctgccgagccgggacgagctggagaggcacggccgcgcggtcgcgcagggcatcgcggctaaatcccccgtggccgtggctgggaccaagcaggtgctgctctaccaaagggaccacaccgtcgccgatggcctggactacgtcaacacctggaacgctggcatgctgcactcggctgatttcgccgaggtgtttgcggccatgaaggagaggcgtaagccggtgttcagcaagctctga

SEQ ID NO: 193 - protein, 275 aa, Prototheca moriformis
  MOD_RES (56)..(56): Any amino acid
  MOD_RES (61)..(61): Any amino acid
  MOD_RES (82)..(82): Any amino acid
  MOD_RES (95)..(95): Any amino acid
  MOD_RES (99)..(99): Any amino acid
  MOD_RES (105)..(105): Any amino acid
  MOD_RES (120)..(120): Any amino acid
  MOD_RES (123)..(123): Any amino acid
  MOD_RES (136)..(136): Any amino acid
  MOD_RES (144)..(144): Any amino acid
  MOD_RES (150)..(150): Any amino acid
  MOD_RES (168)..(169): Any amino acid
MAPSPTFKALKVWMDDDLVGHIQLNRPQAANSMNEEMWTELPQATAWLESQSARVXLVTGXGKNFCAGIDVASLGSTVLSHXAGCAARSAYRFRXGLTXLQEAMXALERVRCPTVALVHXHCXGAGVDLITACDIXFATADAKXCVKEVXLAVIADMGTLQRLPGIVXXGHARELSLTARVFSGEEAKQMGLATAALPSRDELERHGRAVAQGIAAKSPVAVAGTKQVLLYQRDHTVADGLDYVNTWNAGMLHSADFAEVFAAMKERRKPVFSKL

SEQ ID NO: 194 - DNA, 363 bp, Prototheca moriformis
atggcgttcttgcagcggacgagcgcgctggtgcgccagggtgtcctgtctcgcctcgccgtgcaggccagccccgccctgaacagcgtccgggccttcgcctcggcgtcctacctggacaagaatgaggtgacgcaccgcgtgctgtcgattgtcaagaactttgaccgcgtcgacgccggcaaggtcacggactctgccaacttccagtccgacctgggtctggactcactagacaccgtggagctggtcatggccctggaggaggagtttgcgatcgagatcccggatgcggaggccgacaagatcctctccgtcccggaggcgatttcctacattgccgcgaaccccatggccaagtag

SEQ ID NO: 195 - protein, 120 aa, Prototheca moriformis
MAFLQRTSALVRQGVLSRLAVQASPALNSVRAFASASYLDKNEVTHRVLSIVKNFDRVDAGKVTDSANFQSDLGLDSLDTVELVMALEEEFAIEIPDAEADKILSVPEAISYIAANPMAK

SEQ ID NO: 196 - DNA, 924 bp, Prototheca moriformis
atgccactggaaattcttgtcaagaccaggaatggtcgacctgccttttccagagacggcggcgccattactgtcgatagcacgagtgcgacggtgcaggaggtcaagggcctcatcgctcgcgccaagaagttgagccccgcccgcctgcgcctgacgttgcccgcgccggccggcacgcggcccacggtgctggaggacaagaagcccttggccgactatggtctgcacgacggcgccagcctcgtgctcaaggacctgggacctcagatcgggtaccagatggtctttttctgggagtarttrgggccgctggccatctaccccctcttctacttcctgccytccttgatttacggaaggrcgaccgagcacgtctttgcmcaaaaggcagcgctcgccttctggaccttrcactacgsgaagcgcatcrtggagwcctttttcgtgcacaygtttgggcacgccacgatgcccgtgcgcaatctggtgaagaactgcagctattactggagctttggcgccttcatctcctacttrgtgaaccacccgctctacmcggcgcctcccgcggcccagaccgccgtcgcctttgtggccgccaccctctgcacgctctcgaacttcaagtgtcatctgatcctgagcaacctgcgtgcgcccggaggcagcggctatgtcattccgcgtggcttcctgtttgactacgtcacctgtgccaactacaccgctgaaatctggagctggattttcttctccatcggcacccagtgcttgccggcyctcytyttcaccgtrgctggygccgcgcaaatggccatctgggccgggggcaagcattgccgtctgaaaaagctcttcgacggcaaggagggccgcgagcgctaccccaagcgctacatcatgrttcccccgctgtactga

SEQ ID NO: 197 - protein, 307 aa, Prototheca moriformis
  MOD_RES (101)..(102): Any amino acid
  MOD_RES (115)..(115): Any amino acid
  MOD_RES (122)..(122): Any amino acid
  MOD_RES (128)..(128): Any amino acid
  MOD_RES (138)..(138): Any amino acid
  MOD_RES (141)..(141): Any amino acid
  MOD_RES (145)..(145): Any amino acid
  MOD_RES (147)..(147): Any amino acid
  MOD_RES (152)..(152): Any amino acid
  MOD_RES (180)..(180): Any amino acid
  MOD_RES (187)..(187): Any amino acid
  MOD_RES (261)..(261): Any amino acid
  MOD_RES (263)..(263): Any amino acid
  MOD_RES (266)..(266): Any amino acid
  MOD_RES (268)..(268): Any amino acid
  MOD_RES (303)..(303): Any amino acid
MPLEILVKTRNGRPAFSRDGGAITVDSTSATVQEVKGLIARAKKLSPARLRLTLPAPAGTRPTVLEDKKPLADYGLHDGASLVLKDLGPQIGYQMVFFWEXXGPLAIYPLFYFLXSLIYGRXTEHVFXQKAALAFWTXHYXKRIXEXFFVHXFGHATMPVRNLVKNCSYYWSFGAFISYXVNHPLYXAPPAAQTAVAFVAATLCTLSNFKCHLILSNLRAPGGSGYVIPRGFLFDYVTCANYTAEIWSWIFFSIGTQCLPXLXFTXAXAAQMAIWAGGKHCRLKKLFDGKEGRERYPKRYIMXPPLY

SEQ ID NO: 198 - DNA, 1956 bp, Prototheca moriformis
atggcttccaagtatccccggctgaccaaggtctccgatggcgtgyctgccaacgaggagggcgtcgagtttggacccgaatacagttgcacattcatgaaggaaaagacgctgtccgtgcccgggatcaagtctctgggcgagctctttgcggactcggtgtcgcagcacaagcgccggccgtgcctgggcaagcgcaccaaggacggctacagctggcgcacgtacgagcagacgggccgcgagatcgcggccatgggcgcggcctttgccgcgcgcggcctggcccagcagtcgcgtgtgggcgtgtacgggcccaacgcgcccgagtggatgatcacgatgcaggcgtgcaaccgccagggctactactgcgtgccgctgtacgactckctgggcgagaccgcggtggagttcatcatcaagcacgcggaggtgagcgcggtggcggtggccgggcccaagctggcrgagctggccaargcsctgcccaacgtggcgagccaggtcaagacggtggtcttytgggacgasgccgaccgygcggcggtggaggcggtgcaggcgctgggcgtgggcgtgtttggcttcgacgagtttgtgaagcagggcgaggccgcggaggccgtgccgcccgccagcgtggagggcgaggacctgtgcaccatcatgtacacgagcggcacgacgggcgaccccaagggcgtcatgctcacgcaccgcgccgtgatcgcgacygtgctgagcctgsacgcgttyctgaagagygtggacgtggcgctgggcgagggcgaygccatyytktcyttcctgccgctggcgcacatcttygaccgcgcggcggaggagctgatgctctacgtgggcggcagcatcggctactggagcggcaacgtcaagggcctgctgggcgacatcgcggcgctgcgcccgacgctcttctgctccgtgccgcgcgtgtttgaccgcatctactcctcggtcacgggcaaggtrgagagyggcggctggctcaagcgcaccatgttccaccacgccttcaagaccaagttygggcggctgaagcgcggcgtgccgcaggccaaggccggcggcatctgggacaagatcgtgttcaagaagatcaaggaggcgctgggcgggcggtgcaagatcatcgtctcgggcggcgcgccgctgtcgacgcacgtggaggagttcctgcgcgtctgcatgtgctcgcatgtggtgcaggggtacgggctgaccgagacctgcgcggccagcttcatcgcggagccggccgacatccgccagatgggcacggtcggcccgccgcagccggcggtcagcttccgcctggagggcgtgccggagatgaagtacagccccagcgcggaccccgcgcgtggcgagctgctcatccgcgggcccgcgctcttctccggctactacaaggaccaggagaagacggacgaggtggtcacgccggacggctggttccacacgggcgacatcgcggagatcacgcccgccggcgccatccgcatcatcgaccgcaagaagaacatcttcaagctcgcgcagggcgagtacgtggccgtsgagaagctggagaacacgtacaagatgtcgccggccgtggagcagatctgggtctacggcaacagcttcgagagcgtgctcgtggccgtggtcgtgcccagcgaggacaaggtcaaggcccacggcggctccagcgccgcgcagctcgcctcggacgcygccttcaagaaggccgtgctggacgacctcaccgccgccgccaaggccgacaagctcaagggcttcgagatggtcaagggcgtcatcatcgagcccgagcccttcagcgtcgagaacaacctgctcacgcccaccttcaagctcaagcggccgcagctgctcgaccattaccgcaccgagatcgacgcgctctacgcgagtctgaagaagtag

SEQ ID NO: 199 - protein, 651 aa, Prototheca moriformis
  MOD_RES (16)..(16): Any amino acid
  MOD_RES (131)..(131): Any amino acid
  MOD_RES (157)..(157): Any amino acid
  MOD_RES (161)..(162): Any amino acid
  MOD_RES (175)..(175): Any amino acid
  MOD_RES (178)..(178): Any amino acid
  MOD_RES (181)..(181): Any amino acid
  MOD_RES (246)..(246): Any amino acid
  MOD_RES (251)..(251): Any amino acid
  MOD_RES (253)..(253): Any amino acid
  MOD_RES (256)..(256): Any amino acid
  MOD_RES (265)..(265): Any amino acid
  MOD_RES (267)..(269): Any amino acid
  MOD_RES (277)..(277): Any amino acid
  MOD_RES (332)..(332): Any amino acid
  MOD_RES (334)..(334): Any amino acid
  MOD_RES (351)..(351): Any amino acid
  MOD_RES (528)..(528): Any amino acid
  MOD_RES (581)..(581): Any amino acid
MASKYPRLTKVSDGVXANEEGVEFGPEYSCTFMKEKTLSVPGIKSLGELFADSVSQHKRRPCLGKRTKDGYSWRTYEQTGREIAAMGAAFAARGLAQQSRVGVYGPNAPEWMITMQACNRQGYYCVPLYDXLGETAVEFIIKHAEVSAVAVAGPKLXELAXXLPNVASQVKTVVXWDXADXAAVEAVQALGVGVFGFDEFVKQGEAAEAVPPASVEGEDLCTIMYTSGTTGDPKGVMLTHRAVIAXVLSLXAXLKXVDVALGEGXAXXXFLPLAHIXDRAAEELMLYVGGSIGYWSGNVKGLLGDIAALRPTLFCSVPRVFDRIYSSVTGKXEXGGWLKRTMFHHAFKTKXGRLKRGVPQAKAGGIWDKIVFKKIKEALGGRCKIIVSGGAPLSTHVEEFLRVCMCSHVVQGYGLTETCAASFIAEPADIRQMGTVGPPQPAVSFRLEGVPEMKYSPSADPARGELLIRGPALFSGYYKDQEKTDEVVTPDGWFHTGDIAEITPAGAIRIIDRKKNIFKLAQGEYVAXEKLENTYKMSPAVEQIWVYGNSFESVLVAVVVPSEDKVKAHGGSSAAQLASDXAFKKAVLDDLTAAAKADKLKGFEMVKGVIIEPEPFSVENNLLTPTFKLKRPQLLDHYRTEIDALYASLKK

SEQ ID NO: 200 - DNA, 1122 bp, Prototheca moriformis
atggcgtccycycagctcctgtccaagtcccagggtctggtcggtgccctgaaggacgtcagggccgtccgggtgyccctgccccgcgccggaccccytgccgcccctcgcgccgatgcctactcgagctccagggcgcctgcctccatggtgctggccccccagcgccgcgggctgagcgtgaaggctgccgccagcaccagccctgccggcaccggcttgcccattgatctgcggggcaagaaggcctttatcgcgggcgtcgccgacgaccagggttttggctgggccatrgccaagcagctggctgaggcgggcgcggagatctccctgggcgtgtgggtgcctgccctgaacattttcgagagcaactaccgccgcggcaagtttgacgagaaccgcaagctggccaacggcggcctgatggagtttgcgcacatctaccccatggatgcggtcttcgactcgcccgcggacgtgcccgaggacattgccagcaacaagcgctacgccgggaacaagggctggacggtgagcgagacggccgacaaggtcgcggccgacgtgggcaagatcgacatcctggtgcactcgctggccaacgggcccgaggtgcagaagccgctgctggagaccagccgccgcggctacctcgccgcsctgagcgcctcctcctactccctcatctccatggtccagcgctttggcccgctcatgaaccccggcggcgccgtcatctcgctgacctacaacgcctccaacctggtcatccccggctacggcggcggcatgagcacggccaaggccgcgctcgagtccgacacgcgcgtgctggcctacgaggccggccgcaagtaccacgtgcgcgtgaacaccatcagcgccgggccgctcggctcgcgcgccgccaaggccatcggcttcatcgacgacatgatccgctactcgtacgagaacgcgcccatccagaaggagctcagcgcctacgaggtcggcgcsgccgccgccttcctctgctccccgctcgcctcggccgtcactggccacgtcatgtttgtcgacaacggcctcaacaccatgggcctcgccctcgactccaagaccctcgaccycagcgagtga

SEQ ID NO: 201 - protein, 373 aa, Prototheca moriformis
  MOD_RES (4)..(4): Any amino acid
  MOD_RES (26)..(26): Any amino acid
  MOD_RES (33)..(33): Any amino acid
  MOD_RES (98)..(98): Any amino acid
  MOD_RES (220)..(220): Any amino acid
  MOD_RES (333)..(333): Any amino acid
  MOD_RES (371)..(371): Any amino acid
MASXQLLSKSQGLVGALKDVRAVRVXLPRAGPXAAPRADAYSSSRAPASMVLAPQRRGLSVKAAASTSPAGTGLPIDLRGKKAFIAGVADDQGFGWAXAKQLAEAGAEISLGVWVPALNIFESNYRRGKFDENRKLANGGLMEFAHIYPMDAVFDSPADVPEDIASNKRYAGNKGWTVSETADKVAADVGKIDILVHSLANGPEVQKPLLETSRRGYLAXLSASSYSLISMVQRFGPLMNPGGAVISLTYNASNLVIPGYGGGMSTAKAALESDTRVLAYEAGRKYHVRVNTISAGPLGSRAAKAIGFIDDMIRYSYENAPIQKELSAYEVGXAAAFLCSPLASAVTGHVMFVDNGLNTMGLALDSKTLDXSE

SEQ ID NO: 202 - DNA, 1326 bp, Prototheca moriformis
atggcgcagaacctcatcctctccatgccgtgggaggagtcggcgtgctcgtccctgggcctgtccctttctgagctgcgatttgttgtatcattttttgcctacgtgctcgtgtccgccgtgctccgccacatccgtggcacccggacccggcactggtttgccctcgtcaccgggttcctgctcatctactacccctttggctcgggcgtgatgcacgcctttgtgtcctccaccrtggtgtacctggckatggcggcagtgccctcccactgcgggacsctggcctggctcatrgcctttccgtacctcatcctcaaccacgtgctccaggccagcggcctmagctggaaggagggccayctggatttcacgggcgcgcaaatggtgctgacgttgaagctgatcgccgtcggcgtctgctaccaggacggccggtccggccagtcgtacgcragccactaccgccagtccatgcgcctgcccycgctgccgggcctcctggagtactacagctactgctttgcctacggcaacctcctggccggcccctttttcgaggcgaaagagtactttgatttcatggcscggcagggrgagtgggacgagggcgagcacggccgcctgcccygcggcctgggcgccggcctggtccgcttcctcaagggcatcctgtgcgccgcgctgtggatgcagctgggcaagcgcttcagcgcgagtctgctcgagtcggtcttctggaccacgctgtccgtcccgcgacgaatggcgctgatctgggtcatcggctttgccgcgcggctcaagtactactttgtctggtcggtggccgagtctgggctcatcctgtcsggccagtgcttcgccggcaagacccaaaagggcaaggcgcagtggacgcggtacatcaacaccaagatcagggagctgacgtcgggcatctggcacgggctcttccccggctactgggcctttttcgggacgagcgcgctcatgttcgaggcggccaagaccatctaccgctacgagctgggctggccggcctggctgcgcgcggcgctgccctggcgcgccctcaagatggcgctcacggcctttgtgctcaactatgccgccatgtccttcctggtgctcacctgggccgacacctgggccgtctggaagtcggtgggcttcctggggcacacgctgctgctcctgatcctcatagtcggcgtcgtgctgccgccccgccgccgacacaagggccaggccaccaccgcgcccgtggtcacgcccgccgccatcccggccgagggagagctgccmcayaagaaggcagagtga

SEQ ID NO: 203 - protein, 441 aa, Prototheca moriformis
  MOD_RES (80)..(80): Any amino acid
  MOD_RES (84)..(84): Any amino acid
  MOD_RES (94)..(94): Any amino acid
  MOD_RES (99)..(99): Any amino acid
  MOD_RES (115)..(115): Any amino acid
  MOD_RES (121)..(121): Any amino acid
  MOD_RES (152)..(152): Any amino acid
  MOD_RES (163)..(163): Any amino acid
  MOD_RES (196)..(196): Any amino acid
  MOD_RES (199)..(199): Any amino acid
  MOD_RES (211)..(211): Any amino acid
  MOD_RES (284)..(284): Any amino acid
  MOD_RES (436)..(437): Any amino acid
MAQNLILSMPWEESACSSLGLSLSELRFVVSFFAYVLVSAVLRHIRGTRTRHWFALVTGFLLIYYPFGSGVMHAFVSSTXVYLXMAAVPSHCGXLAWLXAFPYLILNHVLQASGXSWKEGXLDFTGAQMVLTLKLIAVGVCYQDGRSGQSYXSHYRQSMRLPXLPGLLEYYSYCFAYGNLLAGPFFEAKEYFDFMXRQXEWDEGEHGRLPXGLGAGLVRFLKGILCAALWMQLGKRFSASLLESVFWTTLSVPRRMALIWVIGFAARLKYYFVWSVAESGLILXGQCFAGKTQKGKAQWTRYINTKIRELTSGIWHGLFPGYWAFFGTSALMFEAAKTIYRYELGWPAWLRAALPWRALKMALTAFVLNYAAMSFLVLTWADTWAVWKSVGFLGHTLLLLILIVGVVLPPRRRHKGQATTAPVVTPAAIPAEGELXXKKAE

SEQ ID NO: 204 - DNA, 1080 bp, Prototheca moriformis
atgtccgtccaacccatttccgaggagctgaccaaggtgaccgtcatcggcgccggcgcctggggtaccgccctcgccatccactgcgcccgcaagggccatgacaccatgttgtgggccatggagccgcacgcggtggaggagatcaacaccaagcacaccaacgagactttcctgaagaacgtgcccctgcctgagtcgctcaaggcgacgggcgacatcaaggaggccgtggagcgcgcggagatgatcctgaccgtcatcccgactcccttcttgttcaagtcgatgagcgggatcaaggagtacctgagggaggaccagtacatcgtgtcctgcaccaagggcattctgaacgacaccctggagacccccgacggcatcatccgccgcgccctgcccgataacctctgcaagaggctggcgttcctgtcgggcccctcctttgcggccgaggtgggccgcgacttccccacggcggtcaccatcgcggccgaggacccggccgtggcgcagcgcgtgcagcagctcatgtccaccaaccgcttccgctgctaccgcaccaccgacgtcgtgggcgtcgagctcgctggcgcgctgaagaacgtgctggccatcgcctgcggcatctccgacggctgcggctttggcaacaacggccgcgcggcgctcatcacgcgcgggctggacgagatcacgcgcatcgcggtggccagcggcgccaacccgctgaccctggcgggcctggcgggcgtgggcgacatcgtgctcacctgctgcggcgacctgagccgcaaccgcacggtcggcctgcgcctgggcaagggtgagaagctggaccacatcgtcaagacgctgggcgccacggccgagggcgtgctcacctcgcgcgcggcctacgacctcaccaagaagctgggcatcgactgcgccgtcatccacggcatctaccgcgtcgtgaacgaggaggccgagcccatgaaggtcgtggccgagaccatggcgcgcccgctgcgcgccgaggtggccgagagcgtcgccgaggccgccgtcaccaacgcccgcaacctcgccgagtag

SEQ ID NO: 205 - protein, 359 aa, Prototheca moriformis
MSVQPISEELTKVTVIGAGAWGTALAIHCARKGHDTMLWAMEPHAVEEINTKHTNETFLKNVPLPESLKATGDIKEAVERAEMILTVIPTPFLFKSMSGIKEYLREDQYIVSCTKGILNDTLETPDGIIRRALPDNLCKRLAFLSGPSFAAEVGRDFPTAVTIAAEDPAVAQRVQQLMSTNRFRCYRTTDVVGVELAGALKNVLAIACGISDGCGFGNNGRAALITRGLDEITRIAVASGANPLTLAGLAGVGDIVLTCCGDLSRNRTVGLRLGKGEKLDHIVKTLGATAEGVLTSRAAYDLTKKLGIDCAVIHGIYRVVNEEAEPMKVVAETMARPLRAEVAESVAEAAVTNARNLAE

SEQ ID NO: 206 - DNA, 360 bp, Prototheca moriformis
atggcgatgtctatgacctcctgccgcgccgtctgcgcccctcgcgccaccctccgggtgcaggctccccgcgtggctgtccgccccttccgcgcccagcgcatgatctgccgcgctgtggacaaggctagcgtcctgagcgacgtgcgcgtgatcattgccgagcagctgggcaccgatgtcgagaaggtcaacgccgacgccaagtttgccgacctgggtgccgactccctggacaccgttgagatcatgatggctctggaggagaagtttgacctgcagctcgatgaggagggtgcggagaagatcaccaccgtgcaggaggccgctgacctcatctccgcccagatcggcgcttga

SEQ ID NO: 207 - protein, 119 aa, Prototheca moriformis; identical to SEQ ID NO: 89

SEQ ID NO: 208 - DNA, 708 bp, Prototheca moriformis
atgtcgctgaggagcgcctacctcactgtttataatgcgtcgctcgcgctgggctgggcgtacctgctgtggctgagcgtgtctgtcctrgccgctggcggcagcctgtgggacctgtggaagactgtggaggtgcctctcaaggtcgttcagacggcggcgatcgcggaagttgtgcatgccagtgttggcattgtccgctcgcccccactcgtcactgccctgcaagtggcttcgcgagtgttcctggtctggggcgtggtgaatctggctccagaggtggcgaccggctcgcaggtggccgccattcccatccccggggtcggccgcgtgggcctctcctttgcgaccctggtcatcgcctgggccctcagcgagatcatccgctacggccactttgccgccaaggaggcgggcattgccagcaagctgctgctctggcttcgctacaccggcttcctggtgctctacccgctgggcgtctccagcgagctgaccatgatctacctagtggctccctacgtcaaggagcgcggcatcctgagcctggagatgcccaacgccgccaactttgcctttagctactacgccgcgctctggatcgtcagcctcacctacattcccgkmywwcmkmkgwwrkmcgggtacatgctcaagcagcggaaaaagatgcttggtggtggcgccaaggccaagaaactggcttga

SEQ ID NO: 209 - protein, 234 aa, Prototheca moriformis
  MOD_RES (30)..(30): Any amino acid
  MOD_RES (208)..(213): Any amino acid
MSLRSAYLTVYNASLALGWAYLLWLSVSVXAAGGSLWDLWKTVEVPLKVVQTAAIAEVVHASVGIVRSPPLVTALQVASRVFLVWGVVNLAPEVATGSQVAAIPIPGVGRVGLSFATLVIAWALSEIIRYGHFAAKEAGIASKLLLWLRYTGFLVLYPLGVSSETMIYLVAPYVKERGILSLEMPNAANFAFSYYAALWIVSLTYIPXXXXXXGYMLKQRKKMLGGGAKAKKLA

SEQ ID NO: 210 - DNA, 1404 bp, Prototheca moriformis
atgcagaccgcgcaccagcggcccccgaccgaggggcactgcttcggtgcgaggctgcccacggcgtcgaggcgggcggtgcgccgggcatggtcccgcatcgcgcgcgcggcggccgcggccgacgcaaaccccgcccgccctgagcgccgcgtggtcatcacgggccagggcgtggtgaccagcctgggccagacgatcgagcagttttacagcagcctgctggagggcgtgagcggcatctcgcagatccaaaagtttgacaccacgggctacacgacgacgatcgcgggcgagatcaagtcgctgcagctggacccgtacgtgcccaagcgctgggccaagcgcgtggacgacgtcatcaagtacgtctacatcgcgggcaagcaggcgctggagaacgcggggctgccgatcgaggcggcggggctggcgggcgcggggctggacccggcgctgtgcggcgtgctcatcggcaccgccatggcgggcatgacgtccttcgcggcgggcgtggaggcgctgacgcgcggcggcgtgcgcaagatgaaccccttttgcatccccttctccatctccaacatgggcggcgcgatgctggcgatggacatcggcttcatgggccccaactactccgtctccacagcctgcgcgacgtccaactacgcatttgtgaacgcggccaaccacatccgcaagggcgacgcggacgtcatggtcgtgggcggcaccgaggcctccatcgtgcccgtgggcctgggcggctttgtggcctgccgcgcgctgtccacgcgcaacgacgagcccaagcgcgcgagccggccgtgggacgagggccgcgacggctttgtgatgggcgagggcgcggccgtgctggtcatggagtcgctggagcacgcgcagaagcgtggcgcgaccatcctgggcgagtacctggggggcgccatgacctgcgacgcgcaccacatgacggacccgcaccccgagggcctgggcgtgagcacctgcatccgcctggcgctcgaggacgccggcgtctcgcccgacgaggtcaactacgtcaacgcgcacgccacctccaccctggtgggcgacaaggccgaggtgcgcgcggtcaagtcggtctttggcgacatgaagggtatcaagatgaacgccaccaagagtatgatcgggcactgcctgggcgccgccggcggcatggaggccgtcgccacgctcatggccatccgcaccggctgggtgcaccccaccatcaaccacgacaaccccatcgccgaggtcgatggcctggacgtcgtcgccaacgccaaggcccagcacgacatcaacgtcgccatctccaactccttcggctttggcgggcacaactccgtcgtcgcctttgcgcccttccgcgagtag

SEQ ID NO: 211 - protein, 467 aa, Prototheca moriformis
MQTAHQRPPTEGHCFGARLPTASRRAVRRAWSRIARAAAAADANPARPERRVVITGQGVVTSLGQTIEQFYSSLLEGVSGISQIQKFDTTGYTTTIAGEIKSLQLDPYVPKRWAKRVDDVIKYVYIAGKQALENAGLPIEAAGLAGAGLDPALCGVLIGTAMAGMTSFAAGVEALTRGGVRKMNPFCIPFSISNMGGAMLAMDIGFMGPNYSVSTACATSNYAFVNAANHIRKGDADVMVVGGTEASIVPVGLGGFVACRALSTRNDEPKRASRPWDEGRDGFVMGEGAAVLVMESLEHAQKRGATILGEYLGGAMTCDAHHMTDPHPEGLGVSTCIRLALEDAGVSPDEVNYVNAHATSTLVGDKAEVRAVKSVFGDMKGIKMNATKSMIGHCLGAAGGMEAVATLMAIRTGWVHPTINHDNPIAEVDGLDVVANAKAQHDINVAISNSFGFGGHNSVVAFAPFRE

SEQ ID NO: 212 - DNA, 963 bp, Prototheca moriformis
atggacgcctttggcgagctcatcatcctgaccgcctcgcgcacgctgctgggccgcgaggtgcgcgagtccatgttccgcgaggtggccgacctcttccacgacctggacgacggcatgcgcccgctgagcgtgctcttcccctacctgccgaccgcctaccacaggcgccgcgacgtcgcgcgccggcgcctgcaggacatcttcaagcgcgtcatcgccgcgcgccgcgcctcgggcgtcaaggaggacgacgtgctgcaggcgctgatcgacgcgcgctaccgcaaggtctacgacggccgcgccacgacggacgaggagatcacgggcctcctcatcgcgctgctcttcgccggccagcacaccagctccgtgacctccacctggacgggyctctacatgatgmcsggcgaccagcgctacttcayggtggtcgaggaggagcagcgccgcgtcgtcgccgagcacggcgacgcgctcgactttgacgtgctcaacggcatggaccgcctgcacctggccatcatggaggccctgcgcctgcagccgcccctcgtcctcctcatgcgctacgccaaggagcccttcgaggtcgtcacctccgacggcaaggccttcaccgtgcccaagggcgacattgtggcgacctcgccctccttctcccaccgcctcaaaaacgtgttccgggatcccaacgacttccaycccgaycgctttgaagcgccccgcgacgaggacaaggccgtgcccttctcctacatcggrtttggcggcgggcggcacgggtgcatgggctcgcagttcgcctacctccagatcaagaccatctggagcgtgctcctccgcaacttcacctttgagctggtggaccccttcccggagccggactgggcctccatggtcatcgggcccaagccctgccgcgtgcgctacacgcgccgaaagacgcccctggcctga

SEQ ID NO: 213 - protein, 320 aa, Prototheca moriformis
  MOD_RES (132)..(132): Any amino acid
  MOD_RES (137)..(137): Any amino acid
  MOD_RES (144)..(144): Any amino acid
  MOD_RES (236)..(236): Any amino acid
  MOD_RES (238)..(238): Any amino acid
  MOD_RES (256)..(256): Any amino acid
MDAFGELIILTASRTLLGREVRESMFREVADLFHDLDDGMRPLSVLFPYLPTAYHRRRDVARRRLQDIFKRVIAARRASGVKEDDVLQALIDARYRKVYDGRATTDEEITGLLIALLFAGQHTSSVTSTWTXLYMMXGDQRYFXVVEEEQRRVVAEHGDALDFDVLNGMDRLHLAIMEALRLQPPLVLLMRYAKEPFEVVTSDGKAFTVPKGDIVATSPSFSHRLKNVFRDPNDFXPXRFEAPRDEDKAVPFSYIXFGGGRHGCMGSQFAYLQIKTIWSVLLRNFTFELVDPFPEPDWASMVIGPKPCRVRYTRRKTPLA

SEQ ID NO: 214 - DNA, 984 bp, Prototheca moriformis
atgcgcatactgggcagcggttcctccaccccttccacggtgctgagcaacgccgatctggagcagctggtggagacgaacgacgagtggatcgttgcccggactggcatccggcgccggcacatcctgggcccgggggagacgctcacccaccactgcaccctggcctgccagcgcgcgctagagatggcgggcgtggacgccaaggacgtggacctcatcctgctggccacgtccagcccggacgactcctttggcagcgcctgtgctgtgcaggccgagctcggggccaagagcgcggccgcctacgacctcaccgccgcctgctccggctttgtcatgagcacggtcaccgccacccaattcttgagaacgggggtgtacaagaacatcctggtcatcggcgcggacgccctgtcccgctacatcgactggcgggaccggagcacgtgcatcctgtttggcgacggcgccggcgctgtcctcctccagcgcgacgatcgcgagggtgaggactcccttctcgggttcgacatgcactctgatgggcacggccagaagcacctccacgccggcttcatgggctgcggcaacaaggccttctcggagcagccctccagcgccgccgctttcggcaacatgtacatgaacggcagcgaggtcttcaagtttgccgtgcgagccgtgccgcgggtggtggaggcctcgctgaaaatggcggggctgagcgtgtccgacatcgactggctggtcctgcaccaggccaaccaacgaattttgacggctgccgccgatcggctgggtgtccccgctgagaaagtggtgtccaatgtggccgagtacggcaacacgtcggccgcctccatccccctcgtgctggacgaatcggtccggcagggcctgatcaagccgggcgacatcctgggcatggcagggtttggggctggcctgtcctgggcgggagccatcctccgatggggctag

SEQ ID NO: 215 - protein, 327 aa, Prototheca moriformis
MRILGSGSSTPSTVLSNADLEQLVETNDEWIVARTGIRRRHILGPGETLTHHCTLACQRALEMAGVDAKDVDLILLATSSPDDSFGSACAVQAELGAKSAAAYDLTAACSGFVMSTVTATQFLRTGVYKNILVIGADALSRYIDWRDRSTCILFGDGAGAVLLQRDDREGEDSLLGFDMHSDGHGQKHLHAGFMGCGNKAFSEQPSSAAAFGNMYMNGSEVFKFAVRAVPRVVEASLKMAGLSVSDIDWLVLHQANQRILTAAADRLGVPAEKVVSNVAEYGNTSAASIPLVLDESVRQGLIKPGDILGMAGFGAGLSWAGAILRWG

SEQ ID NO: 216 - DNA, 996 bp, Prototheca moriformis
atgaaggagcaagtggttatgcccccccctgaggcccccacgaatggggaccttgcggccccctttgtgcggaaggaccggttcggggagtatggcatggccccgcagcccccgatggtgaaggtggtgctggcactcgaggccttggtgctcttgccgctgcgcgcggtgagcgtgctcatcctcgtcgtgctgtactggctcatttgcaatgcttcggtcgcactcccgcccaagtactgcgcggccgtcacggtcaccgctgggcgcttggtctgccggtgggcgctcttctgcttcggattccactacatcaagtgggtgaacctggcgggcgcggaggagggcccccgcccgggcggcattgttagcaaccactgcagctacctggacatcctgctgcacatgtccgattccttccccgcctttgtggcgcgccagtcgacggccaagctgccctttatcggcatcatcagccaaattatgagctgcctctacgtgaaccgcgaccgctcggggcccaaccacgtgggtgtggccgacctggtgaagcagcgcatgcaggacgaggccgaggggaagaccccgcccgagtaccggccgctgctcctcttccccgagggcaccacctccaacggcgactacctgcttcccttcaagaccggcgccttcctggccggggtgcccgtccagcccgtcgtcctccactaccacaggggaaccctgtggcccacgtgggagacgattccggccaagtggcacatcttcctgatgctctgccacccccgccacaaagtgaccgtgatgaagttgcccgtgtacgtccccaatgaggaggaaaaggccgaccccaagctgtacgcccaaaacgtccgcaaagccatgatggaggtcgccgggaccaaggacacgacggcggtgtttgaggacaagatgcgctacctgaactccctgaagagaaagtacggcaagcctgtgcctaagaaaattgagtga

SEQ ID NO: 217 - protein, 331 aa, Prototheca moriformis
MKEQVVMPPPEAPTNGDLAAPFVRKDRFGEYGMAPQPPMVKVVLALEALVLLPLRAVSVLILVVLYWLICNASVALPPKYCAAVTVTAGRLVCRWALFCFGFHYIKWVNLAGAEEGPRPGGIVSNHCSYLDILLHMSDSFPAFVARQSTAKLPFIGIISQIMSCLYVNRDRSGPNHVGVADLVKQRMQDEAEGKTPPEYRPLLLFPEGTTSNGDYLLPFKTGAFLAGVPVQPVVLHYHRGTLWPTWETIPAKWHIFLMLCHPRHKVTVMKLPVYVPNEEEKADPKLYAQNVRKAMMEVAGTKDTTAVFEDKMRYLNSLKRKYGKPVPKKIE

SEQ ID NO: 218 - DNA, 1122 bp, Prototheca moriformis
atggcgtccgcacagctcctgtccaagtcccagggtctggtcggtgccctgaaggacgtcagggccgtccgggtgaccctgccccgcgccggaccccgtgccgcccctcgcgccgatgcctactcgagctccagggcgcctgcctccatggtgctggccccccagcgccgcgggctgagcgtgaaggctgccgccagcaccagccctgccggcaccggcttgcccattgatctgcggggcaagaaggcctttatcgcgggcgtcgccgacgaccagggttttggctgggccatcgccaagcagctggctgaggcgggcgcggagatctccctgggcgtgtgggtgcctgccctgaacattttcgagagcaactaccgccgcggcaagtttgacgagaaccgcaagctggccaacggcggcctgatggagtttgcgcacatctaccccatggatgcggtcttcgactcgcccgcggacgtgcccgaggacattgccagcaacaagcgctacgccgggaacaagggctggacggtgagcgagacggccgacaaggtcgcggccgacgtgggcaagatcgacatcctggtgcactcgctggccaacgggcccgaggtgcagaagccgctgctggagaccagccgccgcggctacctcgccgcgctgagcgcctcctcctactccctcatctccatggtccagcgctttggcccgctcatgaaccccggcggcgccgtcatctcgctgacctacaacgcctccaacctggtcatccccggctacggcggcggcatgagcacggccaaggccgcgctcgagtccgacacgcgcgtgctggcctacgaggccggccgcaagtaccacgtgcgcgtgaacaccatcagcgccgggccgctcggctcgcgcgccgccaaggccatcggcttcatcgacgacatgatccgctactcgtacgagaacgcgcccatccagaaggagctcagcgcctacgaggtcggcgcggccgccgccttcctctgctccccgctcgcctcggccgtcactggccacgtcatgtttgtcgacaacggcctcaacaccatgggcctcgccctcgactccaagaccctcgaccacagcgagtga

SEQ ID NO: 219 - DNA, 1122 bp, Prototheca moriformis
atggcgtccgcacagctcctgtccaagtcccagggtctggtcggtgccctgaaggacgtcagggccgtccgggtgaccctgccccgcgccggaccccgtgccgcccctcgcgccgatgcctactcgagctccagggcgcctgcctccatggtgctggccccccagcgccgcgggctgagcgtgaaggctgccgccagcaccagccctgccggcaccggcttgcccattgatctgcggggcaagaaggcctttatcgcgggcgtcgccgacgaccagggttttggctgggccatcgccaagcagctggctgaggcgggcgcggagatctccctgggcgtgtgggtgcctgccctgaacattttcgagagcaactaccgccgcggcaagtttgacgagaaccgcaagctggccaacggcggcctgatggagtttgcgcacatctaccccatggatgcggtcttcgactcgcccgcggacgtgcccgaggacattgccagcaacaagcgctacgccgggaacaagggctggacggtgagcgagacggccgacaaggtcgcggccgacgtgggcaagatcgacatcctggtgcactcgctggccaacgggcccgaggtgcagaagccgctgctggagaccagccgccgcggctacctcgccgcgctgagcgcctcctcctactccctcatctccatggtccagcgctttggcccgctcatgaaccccggcggcgccgtcatctcgctgacctacaacgcctccaacctggtcatccccggctacggcggcggcatgagcacggccaaggccgcgctcgagtccgacacgcgcgtgctggcctacgaggccggccgcaagtaccacgtgcgcgtgaacaccatcagcgccgggccgctcggctcgcgcgccgccaaggccatcggcttcatcgacgacatgatccgctactcgtacgagaacgcgcccatccagaaggagctcagcgcctacgaggtcggcgcggccgccgccttcctctgctccccgctcgcctcggccgtcactggccacgtcatgtttgtcgacaacggcctcaacaccatgggcctcgccctcgactccaagaccctcgaccgcagcgagtga

SEQ ID NO: 220 - protein, 373 aa, Prototheca moriformis
MASAQLLSKSQGLVGALKDVRAVRVTLPRAGPRAAPRADAYSSSRAPASMVLAPQRRGLSVKAAASTSPAGTGLPIDLRGKKAFIAGVADDQGFGWAIAKQLAEAGAEISLGVWVPALNIFESNYRRGKFDENRKLANGGLMEFAHIYPMDAVFDSPADVPEDIASNKRYAGNKGWTVSETADKVAADVGKIDILVHSLANGPEVQKPLLETSRRGYLAALSASSYSLISMVQRFGPLMNPGGAVISLTYNASNLVIPGYGGGMSTAKAALESDTRVLAYEAGRKYHVRVNTISAGPLGSRAAKAIGFIDDMIRYSYENAPIQKELSAYEVGAAAAFLCSPLASAVTGHVMFVDNGLNTMGLALDSKTLDHSE

SEQ ID NO: 221 - protein, 373 aa, Prototheca moriformis
MASAQLLSKSQGLVGALKDVRAVRVTLPRAGPRAAPRADAYSSSRAPASMVLAPQRRGLSVKAAASTSPAGTGLPIDLRGKKAFIAGVADDQGFGWAIAKQLAEAGAEISLGVWVPALNIFESNYRRGKFDENRKLANGGLMEFAHIYPMDAVFDSPADVPEDIASNKRYAGNKGWTVSETADKVAADVGKIDILVHSLANGPEVQKPLLETSRRGYLAALSASSYSLISMVQRFGPLMNPGGAVISLTYNASNLVIPGYGGGMSTAKAALESDTRVLAYEAGRKYHVRVNTISAGPLGSRAAKAIGFIDDMIRYSYENAPIQKELSAYEVGAAAAFLCSPLASAVTGHVMFVDNGLNTMGLALDSKTLDRSE

SEQ ID NO: 222 - DNA, 1260 bp, Prototheca moriformis
atggcacttccacttccgccactcccatcacttccaaaacttccaaaaattcaatttccttttttttcttggttagattggggaaaagataaacgacttgagaaaaaaaaagaaattgaaaataaaatagagcaacaaataccgaatctaataaagttaagtgcacttaaatataagagagatgttaaagctgaaaaagatttaggtttatggactcgttgtgaaaattgtggtgttattatatacataaaacatttacaagtaaacaaaaaagtttgtataggatgtaattatcatatattaatgagcagttttgaacgaattgctcgctttcttgacatagaaagttggactccattaaatgaaacaatgtcttcaggtaatcctttaggatttagtgatcaaaaatcatatacagaaagattaatagagtctcaagaattaacaggattacaggatgcagttcaaacaggaactggcgttatagaaggtattcctttagcactcggaatgatggatttccattttatgggtggtagtatgggttctgttgttggagaaaaattaactcgtttaattgaatatgcaacaattaaaggcctttctttagtaattttttgtgcttctggtggtgctcgtatgcaagaaggtattttaagtttaatgcaaatggctaaaatttctgctgcattaaatcgtcatcaaaatatagcaaaacttttatatatcccagttttaacatcacctactacaggaggagttactgcaagttttgcgatgctaggagatttaatttatgcagaacctcgtgcacttattggttttgctggacgacgagttatttctcaaacacttcaagaacaattaccaaaagattttcaaacagctgaatatttattacatcatggattaattgatttaattatttcaagatttttcttaaaacaagcattagctgaaacagttattttatttcaacaagctccttcaaaagaaataggatctattgaattccgtgaacgtgttactttaacaaaagttgaagaagaattattaagacgttcaataatcgagaatgaaaactcttttaaaaaaatgttagaatcgtttttatcttttattccaggaagaaaaaaagcaatttcaacagatttagcatttaatgaagttcttgatgaagcttttgataattcattaaatgcttctataacaaaagacttcagttatatgctttcttcaactaaattaattgaagcttaa

SEQ ID NO: 223 - protein, 419 aa, Prototheca moriformis
MALPLPPLPSLPKLPKIQFPFFSWLDWGKDKRLEKKKEIENKIEQQIPNLIKLSALKYKRDVKAEKDLGLWTRCENCGVIIYIKHLQVNKKVCIGCNYHILMSSFERIARFLDIESWTPLNETMSSGNPLGFSDQKSYTERLIESQELTGLQDAVQTGTGVIEGIPLALGMMDFHFMGGSMGSVVGEKLTRLIEYATIKGLSLVIFCASGGARMQEGILSLMQMAKISAALNRHQNIAKLLYIPVLTSPTTGGVTASFAMLGDLIYAEPRALIGFAGRRVISQTLQEQLPKDFQTAEYLLHHGLIDLIISRFFLKQALAETVILFQQAPSKEIGSIEFRERVTLTKVEEELLRRSIIENENSFKKMLESFLSFIPGRKKAISTDLAFNEVLDEAFDNSLNASITKDFSYMLSSTKLIEA

SEQ ID NO: 224 - DNA, 2058 bp, Prototheca moriformis
tcggcacctggatgagggcctggacgacatgccagcccatgtcaaggttgctgcccgtgggcatgacagtgcaagggaaataggtcatctttcacacgctcactataatcaatgaaacatctactttcatcatattgcagtcttctttgatgggagtcggtctaacaatccccatcagtcacggccggctggcactaggtacctggcaaggagtctacttgaatgagcacagggattgcgggggcgcacgccatctgattgtgacgctgcaggggtgctcttcctgatgagggttgggccccatggcagctcggcgcaatctggatctgatcccatgctggggctttaaaactgcgttccgacatgcgacagggacaatgcgcgcccccactgacggcctttcatagccgtcagcataaacaagataccacttgacagagttgcgggttgcaaggggctcaaggcctctgggggcgcgccgctcttcgccatgcaaaccttggctagcacccgcaccgtgcccgcggcgtcgggcaccgatcgggccgctcatggggcgatcagatatcatgcccagcgcattcaatcaaggtttgcggcttcaaggaggggcgcccgggctctgggccccccccgggctgtggcgtctgccaagacgtcccctggggagctgcgcctgccctttagccacgtccgctcggaggaagagctgttcgccattttgcggtccggcgtggcgcatggccagctgcccgcgtcgattctgaaccgcgcctcggagctcatggagtcgtacacggcatccatgaaggccggcggcgttagcgacccgagcgcttacacggtcaagataatggcggagcactttggtctgtccatgctgcaaatggcccatcggcacaagtttgattcggcgcacaagcgggtgctggagccgtacgactactactcctttggccagcgctacatccagggcctcatcgacatgcagcgctcctgcctgggccacgtggaccgcttcgccgagatccaagcgcagctggacagaggcgagaacgtggtgctgctcgcaaaccaccagacggaggccgaccccgcggtgtgggcgctgctgctggagtcgcgcttcccgaagctggcgacggaggtggcgtacgtggcgggcgaccgcgtgatcaccgacccgctctgcatccccttttcgctgggccgcaacctctactgcgtgcactccaagaagcacctggacgacgtcccggagctcaaggcggagaaggccgcgacaaaccgccagaccctgcgcgtcatggcccgcgacctggccgcgggcggggtgctcctctgggttgcgccctcgggcggccgggaccgcgccgtctgcccgagcacgggcgagaccctgcccgacccctttgaccccgcggtcgtggagctcatgcgggccctgctcgccaaggccggccggccggggcacctctggcccctggccatgtactctgccagggtgatgcccccgccgacgaccattgagaaggacattggcgaacggcgggtcgtcggctttgccggctgcggtctctcccccggacccgaactcgatgtggcagccctggtgcctcccaacgtgacggaccgtgcgcagcggcagcagctgctctcggatgcggcgtttgagtccatctctcacgagtacgaccggctgttgaaagcggtgcatgggcagctgagtggtgcggaagccgaggcgtacacccagcccaagctcgagtcctagttgctgcaagtttccctcgcgctgggcggcggtgtgccacccaagcgttggggacctgggttttccaggcttggcctcccaccgccggtcaagactggctctcgacctcggcgaccccggctttccctgtcgtccaatgtgtgcggcactctgagcgacgaccaccacccagtgatgcctcagtttttcactagctcttgcgcatagatagccccctctgaaacctgttcatgccttcaccctcttccaagagtcacctgcaacctttttggcaccaaaaaaaa

SEQ ID NO: 225 - protein, 427 aa, Prototheca moriformis
MQTLASTRTVPAASGTDRAAHGAIRYHAQRIQSRFAASRRGARALGPPRAVASAKTSPGELRLPFSHVRSEEELFAILRSGVAHGQLPASILNRASELMESYTASMKAGGVSDPSAYTVKIMAEHFGLSMLQMAHRHKFDSAHKRVLEPYDYYSFGQRYIQGLIDMQRSCLGHVDRFAEIQAQLDRGENVVLLANHQTEADPAVWALLLESRFPKLATEVAYVAGDRVITDPLCIPFSLGRNLYCVHSKKHLDDVPELKAEKAATNRQTLRVMARDLAAGGVLLWVAPSGGRDRAVCPSTGETLPDPFDPAVVELMRALLAKAGRPGHLWPLAMYSARVMPPPTTIEKDIGERRVVGFAGCGLSPGPELDVAALVPPNVTDRAQRQQLLSDAAFESISHEYDRLLKAVHGQLSGAEAEAYTQPKLES

SEQ ID NO: 226 - DNA, 1242 bp, Prototheca moriformis
ggccggcgtgaagccctccaagggcaggctggtccccgtggccaacccggcctggagcgcgctcatcaactcccactggcaccagtaccttgccatggttctgggctacctcgtgtgcctctacagcgaccgggccacgccctttcgccgcgccatctaccacgagaccgacgccgagctctggaggtatagctacccgctgctcccgaaccaggtccccgcccaggcggtggtgctcctctgcttcaccgccccctttgccgtcatcctgcccttttactttgcgggccgcatctcgcgcatcgtggcgcaccacggcctgctccaggcctttgcggccgtcgtgatcactggccttatcaccaacctcatcaagctgaatgtggcgcgtccccggcccgactttgtggcgcggtgctggccccacggcgccgcgcgcgccttcaccgacgtgggcgtgcccatctgcgcgcccgacgcgatcgactgggtggagggcctcaagtccttcccctccgggcacacctcctgggccgcctcgggcatggcctacctcacgctctggctggtgggcgcgctgcgcgttttctccggcgcggcgcggccgaccagcatcgcggccgcgctgtgcccgctgtgcctggccgcctggatcggcatgacgcgcatccaggaccggtggcaccacacggaggacgtcatggtcggcttcagcctgggcagcacgattgcctacctctgctaccgcgcggtgcactgccccgtcaacggaccgcacgcgggcgcgctcaccgcgctggccctgccggacgaggggcccggcgccgggcccagcatcagccgcgagccgagctttgcgcagatggcggccgcggccggcgtgggcgtgcccctgcagcccgtgcgctacaaccccctcgtggaaaccacgcccgaagagaccgtctaggacggggggtggggcgagaggatgtcaaggctgctgtcggtgtgctgtttctttatgccctggccagtctgccagtgcatgcaccacaattttgacgactgtaccgctaaacacgagctccccctgccaggtgacctcgatgcgtgtggcaaaagaaacgtgtattttgtgcttcccgcccgtgccgttgcgcgggcaggtttttctaccgcctccttctggaatgtgtcgggccgctcgatcgagggcagtggcccctgccattcttcttatttttagaatttgatcctcag

SEQ ID NO: 227 - protein, 284 aa, Prototheca moriformis
MVLGYLVCLYSDRATPFRRAIYHETDAELWRYSYPLLPNQVPAQAVVLLCFTAPFAVILPFYFAGRISRIVAHHGLLQAFAAVVITGLITNLIKLNVARPRPDFVARCWPHGAARAFTDVGVPICAPDAIDWVEGLKSFPSGHTSWAASGMAYLTLWLVGALRVFSGAARPTSIAAALCPLCLAAWIGMTRIQDRWHHTEDVMVGFSLGSTIAYLCYRAVHCPVNGPHAGALTALALPDEGPGAGPSISREPSFAQMAAAAGVGVPLQPVRYNPLVETTPEETV

SEQ ID NO: 228 - DNA, 876 bp, Prototheca moriformis
ctggagctgtgctggccgctgctggcgctgctggcgctggccgacgccgcggccagcgagtgggtcgtcttcgcgctcaacctgctcaacacgagcgcgatcctgggcgtccccgcggccgtcatccactacacacactctgagctcttgcccggctttgcgctctgcaccgtctcggtcatcctctggctcaagaccgtctcctatgcgcactgcaactgggacctgcgcatggcgcaccgcgcgggcgagctgcgcgacggcgagcgcggcagcgcctgggtcccgcgcgactgcgccgcgcagctcaagtacccggagaacctcacgctccggaacttgggatatttcctcgcggcccccacgctgtgctaccagctgagctacccgcggtcggagcggttccggctcaagtggctgctgcgccgcgtgctcatgtttgccctcaccatcacgctgatgatgttcatgatcgagcagtacgtgaacccgctcatccacaacagcctgcagccgatgatgagcatggactggctgcgcctgttcgagcgcgtgctcaagctgtcgctgcccaacctctacctctggctgctcatgttctacgcgggcttccacctctggctcaacatcgccgccgagctgaccatgtttggcgaccgcgagttctacaaggagtggtggaacgcgaccaccatcggcgagtactggcgcctctggaaccagcccgtgcaccagtggatgctgcgccactgctacttcccctgcgtgcgccacggcgtgcccaaggtctgggcaggcatcgtcgtcttcttcgtcagtgccgtcttccacgagtggatcgtcgcgctgcccctgcacatggtcaagggctgggcc

SEQ ID NO: 229 - protein, 292 aa, Prototheca moriformis
MELCWPLLALLALADAAASEWVVFALNLLNTSAILGVPAAVIHYTHSELLPGFALCTVSVILWLKTVSYAHCNWDLRMAHRAGELRDGERGSAWVPRDCAAQLKYPENLTLRNLGYFLAAPTLCYQLSYPRSERFRLKWLLRRVLMFALTITLMMFMIEQYVNPLIHNSLQPMMSMDWLRLFERVLKLSLPNLYLWLLMFYAGFHLWLNIAAELTMFGDREFYKEWWNATTIGEYWRLWNQPVHQWMLRHCYFPCVRHGVPKVWAGIVVFFVSAVFHEWIVALPLHMVKGWA

SEQ ID NO: 230 - DNA, 876 bp, Prototheca moriformis
ctggagctgtgctggccgctgctggcgctgctggcgctggccgacgccgcggccagcgagtgggtcgtcttcgctttgaacctggtcaacacgagcgcgatcctgggcgtccccgccgcggtcatccactacacgcactctgagctgctgcccggctttgcgctctgcaccgtgtcggtcatcctctggctcaagaccgtgtcctacgcgcactgcaactgggacctgcgcatggcgcaccgcgcgggcgagctgcgcgacggcgagcgcgacagcgcctgggtcccgcgcgactgcaccgcgcagctcaagtacccggagaacctcacgctgcgcaacctgggctactttttggcggcgcccacgctgtgctaccagctgagctacccgcggtcggagcggttccggctcaagtggctgctgcgccgcgtgctcatgtttgcgctcaccatcacgctgatgatgttcatgatcgagcagtacgtgaacccgctgatccacaacagcctgcagccgatgatgagcatggactggctgcgcctcttcgagcgcgtgctcaagctgtcgctgcccaacctctacctctggctgctcatgttctacgcgggcttccacctctggctcaacatcgccgccgagctgaccatgtttggcgaccgcgagttctacaaggagtggtggaacgcgaccaccgtcggcgagtactggcgcctctggaaccagcccgtgcaccagtggatgctgcgacactgctacttcccctgcgtgcgccacggcgtgcccaaggtctgggccggcatcgtcgtcttcttcgtcagcgccgtcttccacgagtggatcgtcgcgctgcccctgcacatggtcaagggctgggcc

SEQ ID NO: 231 - protein, 292 aa, Prototheca moriformis
MELCWPLLALLALADAAASEWVVFALNLVNTSAILGVPAAVIHYTHSELLPGFALCTVSVILWLKTVSYAHCNWDLRMAHRAGELRDGERDSAWVPRDCTAQLKYPENLTLRNLGYFLAAPTLCYQLSYPRSERFRLKWLLRRVLMFALTITLMMFMIEQYVNPLIHNSLQPMMSMDWLRLFERVLKLSLPNLYLWLLMFYAGFHLWLNIAAELTMFGDREFYKEWWNATTVGEYWRLWNQPVHQWMLRHCYFPCVRHGVPKVWAGIVVFFVSAVFHEWIVALPLHMVKGWA

SEQ ID NO: 232 - DNA, 1257 bp, Prototheca moriformis
atgccccgattacgaaatattgctactgcgttgctgatcgggcccgctgcccgtgcctgcaccatggggcacgccattgacgttcgacccgttgaaccggacacacattttttaaatttaattcatctcagtagtcgtcgcaatgacggaggccgtctcggacagggatgctctgcaaccggagctgggcttcgtgcagaagctgggcatgtactttgcgctgccagtttggatgataggcctcgtggtgggcgccctctggcttcccgtgaccgtggtgtgcctcttcatcttcccaaagctggcgacattgagtctggggctgctgctggtggcgatgctcacccccctgtcgctgccctgccccaagccgctggcccgcttcctggcctactgcaccaccgccgcggccgagtactaccccgtgcgcttcatctacgaggacaaggaggagatggaggccaccaagggccccgtcatcatcgggtacgagccccacagcgtcatgcctcaggccatctccatgtttgccgagtacccgcaccccgccgtggtcggcccgctgcgcaaggcgcgcgtgctggcatccagcaccggcttctggacgccgggcatgcggcacctgtggtggtggctgggcacgcgccccgtgagcaagccctccttcctcgcccagctgcgcaagcagcgctccgtcgccctctgcccgggcggcgtgcaggagtgcctctacatggcccacggcaaggaggtcgtctacctccgcaaacgctttggatttgtcaagtacgagtttgtgtgcagcaaaggggggtggagagatgtcctccaatctcaccaatccaatctactcttcctcatgactcccgttcatgtcaccgtacgcgcagactggccatccagaccggcaccccgctggtcccggtcttcgcctttggccagacggagacctacacctttgtgcggcccttcatcgactgggagacgcgcctgctgccgcggtccaagtacttttcgctggtgcgccgcatgggctacgtgcccatgatcttcttcggccacctgggcacggccatgcccaagcgcgtgcccatccacatcgtcatcggccggcccatcgaggtgccgcagcaggacgagcccgacccggccacggtgcagcagtacctcgacaagttcatcgacgccatgcaggcaatgtttgagaagcacaaggccgacgccggctaccccaacctgacgctcgagatccactga

SEQ ID NO: 233 - protein, 418 aa, Prototheca moriformis
MPRLRNIATALLIGPAARACTMGHAIDVRPVEPDTHFLNLIHLSSRRNDGGRLGQGCSATGAGLRAEAGHVLCAASLDDRPRGGRPLASRDRGVPLHLPKAGDIESGAAAGGDAHPPVAALPQAAGPLPGLLHHRRGRVLPRALHLRGQGGDGGHQGPRHHRVRAPQRHASGHLHVCRVPAPRRGRPAAQGARAGIQHRLLDAGHAAPVVVAGHAPREQALLPRPAAQAALRRPLPGRRAGVPLHGPRQGGRLPPQTLWICQVRVCVQQRGVERCPPISPIQSTLPHDSRSCHRTRRLAIQTGTPLVPVFAFGQTETYTFVRPFIDWETRLLPRSKYFSLVRRMGYVPMIFFGHLGTAMPKRVPIHIVIGRPIEVPQQDEPDPATVQQYLDKFIDAMQAMFEKHKADAGYPNLTLEIH

SEQ ID NO: 234 - DNA, 1662 bp, Prototheca moriformis
  modified_base (716)..(725): a, c, t, g, unknown or other
atgtcgacagctcgggcaatggccgcggggccgccctctcggtgttttgctcccagctcaacccaggcagcctgcgtccgcccggttaacccctcgcgaagggtctgtgcccgggcgggcatgcgcatgctgggcagcggttcctccaccccttccacggtgctgagcaacgccgatctggagcagctggtggagacgaacgacgagtggatcgttgcccggactggcatccggcgccggcacatcctgggccctggggagacgctcacccaccactgcaccctggcctgccagcgcgcgctagagatggcgggcgtggacgccaaggacgtggacctcatcctgctggccacgtccagcccggacgactcctttggcagcgcctgtgctgtgcaggccgagctcggggccaagagcgcggccgcctacgacctcaccgccgcctgctccggctttgtcatgagcacggtcaccgccacccagttcttgagaacgggggtgtacaagaacatcctggtcatcggcgcggacgccctgtcccgctacatcgactggcgggaccggagcacctgcatcctgtttggcgacggcgccggcgccgtcctcctccagcgcgacgatcgcgagggcgaggactcccttctcgggttcgacatgcactctggtacgctgcaatggtcgaagcggggcatccatccaacccttccacacaccgnnnnnnnnnncgcggccgcctacgacctcaccgccgcctgctccggctttgtcatgagcacggtcaccgccacccaattcttgagaacgggggtgtacaagaacatcttggtcatcggcgcggacgccctgtcccgctacatcgactggcgggaccggagcacgtgcatcctgtttggcgacggcgccggcgctgtcctcctccagcgcgacgatcgcgagggtgaggactcccttctcgggttcgacatgcactctggtacgctgcaatggtggggggtggacgaagaggggacgaattggagccatcaagctgcccatgcgtgctgtactgtgctcttccacgggccacacctagcatccatccaacctttccacccacgctcttcagatgggcacggccagaagcacctccacgccggcttcatgggctgcggcaacaaggccttctcggagcagccctccagcgccgccgctttcggcaacatgtacatgaacggcagcgaggtcttcaagtttgccgtgcgagccgtgccgcgggtggtggaggcctcgctgaaaaaggcggggctgagcgtgtccgacatcgactggctggtcctgcaccaggccaaccaacgaattttgacggctgccgccgatcggctgggtgtccccgctggtgcgcacgcatgcggtgctgcggctggggatgcgctgttcgactgtgtgtcacagcgccattttgccgacccgggcgctctgtgtggtgggatgctcaacgctcagtcccgatttcttaagaaagtggtgtctaatgtggccgagtacggcaacacctcggccgcgtccatccccctcgtgctggacgaatcggtccggcagggcctgatcaagccgggcgacatcctgggcatggcagggtttggggctggcctgtcctgggcgggagccatcctccgatggggc

SEQ ID NO: 235 - protein, 441 aa, Prototheca moriformis
  MOD_RES (210)..(213): Any amino acid
MLGSGSSTPSTVLSNADLEQLVETNDEWIVARTGIRRRHILGPGETLTHHCTLACQRALEMAGVDAKDVDLILLATSSPDDSFGSACAVQAELGAKSAAAYDLTAACSGFVMSTVTATQFLRTGVYKNILVIGADALSRYIDWRDRSTCILFGDGAGAVLLQRDDREGEDSLLGFDMHSDELEPSSCPCVLCCALPWATPSIHPTLPHTXXXXAAAYDLTAACSGFVMSTVTATQFLRTGVYKNILVIGADALSRYIDWRDRSTCILFGDGAGAVLLQRDDREGEDSLLGFDMHSDGHGQKHLHAGFMGCGNKAFSEQPSSAAAFGNMYMNGSEVFKFAVRAVPRVVEASLKKAGLSVSDIDWLVLHQANQRILTAAADRLGVPAEKVVSNVAEYGNTSAASIPLVLDESVRQGLIKPGDILGMAGFGAGLSWAGAILRWG

SEQ ID NO: 236 - DNA, 1038 bp, Prototheca moriformis
atggcgggcgtcccacacagctctctggagctcgatccgctgtcgagcagagccgagctcgaggtggggatcagggcggtctgccgcgatctgctgccgggctggaagggccttgccgacgatgcgatagagatcaccaccattacgggcgggatcagcaatgcgctgtacaaggcgaccccgaccgtggacggggacctgggaccggtcctctgccgggtgtacggcctcaacaccgatcactttatcgagcggaagaaggaggtggccatcatgcagattgtgaacgagcacggatttggcaccgaggtgctggggacgtttgcgacgggccggctggaggcctttttgcctcaaaagtgcctggagccggagcarctcaaggacccccagatctcrgcggccattgcccgggccatggcccgtttccacgccgtcccrgggccgggccccaagacggcgtccacgccgtttggccgcatccacaagtggctggacatggcgagcgggtttacctgggacgacccgcagaagcgggaggggtttgaggcgtttgacctctcggagctgcggcrgcaggtggaggaggtggaggcgctctgcrgcgcrgtcggsggccccatcgtcttygggcacaacgatctcctggccggcaacgtcatggcctcggaggcctttctgcagcgcgcgcagcgcggcgagcggccggacccggackcggacgtccgcgcgagcgccgagagcgacctgacctttatcgactttgagtatgccgactggacgccgcgaggattcgactggggcaaccactttaacgagtgatttgcgggcttcgacggcaactacgacaactacccaacccccgccgaggcggccgtgtttgtgcgggcctacatggcggcggagcgcggctgcgaggrragcgcggtcccggacgcggacgtggaccgsgcggtgrtcgaggcggayctgtttgcgctggcyagccaccaktactggggcgcctggtgcttcytgcaggcgcartggtcmaarctk

SEQ ID NO: 237 - protein, 345 aa, Prototheca moriformis
  MOD_RES (192)..(192): Any amino acid
  MOD_RES (202)..(202): Any amino acid
  MOD_RES (240)..(240): Any amino acid
  MOD_RES (306)..(306): Any amino acid
  MOD_RES (319)..(319): Any amino acid
  MOD_RES (330)..(330): Any amino acid
MAGVPHSSLELDPLSSRAELEVGIRAVCRDLLPGWKGLADDAIEITTITGGISNALYKATPTVDGDLGPVLCRVYGLNTDHFIERKKEVAIMQIVNEHGFGTEVLGTFATGRLEAFLPQKCLEPEQLKDPQISAAIARAMARFHAVPGPGPKTASTPFGRIHKWLDMASGFTWDDPQKREGFEAFDLSELRXQVEEVEALCXAVGGPIVFGHNDLLAGNVMASEAFLQRAQRGERPDPDXDVRASAESDLTFIDFEYADWTPRGFDWGNHFNEFAGFDGNYDNYPTPAEAAVFVRAYMAAERGCEXSAVPDADVDRAVXEADLFALASHXYWGAWCFLQAQWSKL

SEQ ID NO: 238 - DNA, 1218 bp, Prototheca moriformis
atgtcgtcagtcgtgatcagctccaggacgggctgcctcccccgcgccgcggcggggccgggccgcccccagctcgcctgctcgttccggccggggtcccacccgccccgggcgggcgcccccggcccccgcccgcgccgcggcgtggccccgctgtctgccgtggctaccccgctcaaggatgcgcccgcgcagccctccagcaagccctcgatcagcgccgaggtggccaaggagctctaccgggacatggtgcttggtcgggagtttgaggagatgtgcgcgcagatgtactaccgcggcaagatgtttggattcgtgcacctctactcgggccaggaggccgtgtcgacaggcgtgatcaagggctgccttcgcaaggacgactacatctgctccacgtaccgggaccacgtgcacgcgctgagcaagggcgtggcggcgcgcaaggtgatggcggagctgtttggcaagcgtacgggcgtgtgccgcggccagggtgggtccatgcacatgtttgacgcggagcacgggctgctgggcgggtacgccttcatcggcgagggtatccccgtgggcctgggcgcggccttctcggtggcctaccgccgcaacgtgctcggcgaggacggcgcggaccaggtgtctgtcaacttcttcggggacggcacctgcaacgtgggccagttctacgagtcgctcaacatggccagcctgtacaagctgccctgcatctttgtggtggagaacaacctgtgggccatcggcatgaaccacccgcggtccacggggcccacgctgggcgaccaggagccctggatctacaagaagggacccgcctttggcatgccgggcgtgcgcgtggacggcatggacgtgctcaaggtgcgggaggtcgcgctggaggccgtggagcgcgcgcgccgcggcgaggggcccacgctgatcgaggccgagacctaccgcttccgcgggcactccctggccgacccggacgagctgcgcagcaaggaggagaaggccaagtacgcggcgcgcgaccccatcccgcagctcaagcgcttcatgctcgacaagggactggccaccgaggaggagctgcgcgacctcgaggccggcgtcgccgccgaggtggaggagtcggtcacctttgccgaggccagccccaagcccgacatgtcccagctcctggaaaacgtgtttgccgaccccaagggc

SEQ ID NO: 239 - protein, 406 aa, Prototheca moriformis
MSSVVISSRTGCLPRAAAGPGRPQLACSFRPGSHPPRAGAPGPRPRRGVAPLSAVATPLKDAPAQPSSKPSISAEVAKELYRDMVLGREFEEMCAQMYYRGKMFGFVHLYSGQEAVSTGVIKGCLRKDDYICSTYRDHVHALSKGVAARKVMAELFGKRTGVCRGQGGSMHMFDAEHGLLGGYAFIGEGIPVGLGAAFSVAYRRNVLGEDGADQVSVNFFGDGTCNVGQFYESLNMASLYKLPCIFVVENNLWAIGMNHPRSTGPTLGDQEPWIYKKGPAFGMPGVRVDGMDVLKVREVALEAVERARRGEGPTLIEAETYRFRGHSLADPDELRSKEEKAKYAARDPIPQLKRFMLDKGLATEEELRDLEAGVAAEVEESVTFAEASPKPDMSQLLENVFADPKG

SEQ ID NO: 240 - DNA, 1143 bp, Prototheca moriformis
atgcagagcgcgctcaaaaccgtgaccaaccccgtgtcgggggtctcgccccgccccgccccggtcgggtcccgggtgcccggcgtccatgtggcccggcgccaggtcttccgaggtgggcccctgcgtgccaagtcggccaagaaggagatgatgatgtgggaggccctgcgcgagggcctggacgaggagatggagcgcgaccccaaagtctgcctcatcggcgaggacgtgggtcactacggcggttcgtacaaggtgtcgtacggcctgcacaaaaagtacggcgacatgcgcctgctggacacgcccatctgcgagaacggcttcctgggcatgggcgtgggcgcggcgatgacgggcctgcggcccgtggtggagggcatgaacatgggcttcctgctgctggccttcaaccagatcagcaacaactgcggcatgctgcactacacgagcggcgggcagttcaaggtgcccatggtcgtgcgcgggcccggcggcgtggggcgccagctgggcgccgagcactcgcagcggctggagtcctacttccagtccatccccggcgtgcagctggtggcggtgtccacgcccaagaacgccaaggccctcttcaaggccgccatccgctcggacaaccccatcatcttcttcgaacacgtgctcctgtacaacatcaagggcgaggtggagggccccgaccacgtgcagagcctggagcgcgccgaggtcgtgcgcccgggcgcggacgtgacggtgctctgctactcgcgcatgcgctacgtggccatgcaggccgtgcagcagctggagcgcgagggctacgaccccgaggtcatcgacctcatctccctcaagcccttcgacatggagaccatcgcgcgctccgtgcgcaagacgcggcgcgtcatcatcgtggaggagtgcatgaagaccggcggcatcggcgcctcgctctccgccgtcatccacgagtccctcttcgacgacctcgaccacgaggtcatccgcctctcctcccaggacgtgcccaccgcctacgcctacgaactggaggcagcaaccatcgtccagcccgaaaaggtcatcgccgccgtgaaaaaggtcgtcggcagcccctccaaggccctcagctacgcgtga

SEQ ID NO: 241 - protein, 380 aa, Prototheca moriformis
MQSALKTVTNPVSGVSPRPAPVGSRVPGVHVARRQVFRGGPLRAKSAKKEMMMWEALREGLDEEMERDPKVCLIGEDVGHYGGSYKVSYGLHKKYGDMRLLDTPICENGFLGMGVGAAMTGLRPVVEGMNMGFLLLAFNQISNNCGMLHYTSGGQFKVPMVVRGPGGVGRQLGAEHSQRLESYFQSIPGVQLVAVSTPKNAKALFKAAIRSDNPIIFFEHVLLYNIKGEVEGPDHVQSLERAEVVRPGADVTVLCYSRMRYVAMQAVQQLEREGYDPEVIDLISLKPFDMETIARSVRKTRRVIIVEECMKTGGIGASLSAVIHESLFDDLDHEVIRLSSQDVPTAYAYELEAATIVQPEKVIAAVKKVVGSPSKALSYA

SEQ ID NO: 242 - DNA, 1314 bp, Prototheca moriformis
atgccggcgctctcgcccacgatgtcccagggcaacctggtggagtggacggtgaaggaggggcaggaggtcgcgcccggcgactccctggccgaggtcgagacggacaaggccaccatgacgtgggagaatcaggatgacggctttgtggccaagatcctggtgcccgccggcgcccagggcatcgaggtcggcacgcccgtcctggtactggtcgaggacgaggcggacgtggccgccttcaaggactacaagccccagggccaggcagcggcggccggggacaataaggaggaggggtccgagagcaaggccccggccgcgaaggccgagaaggcgagtgcggcgtctggcgtggcgaggaacgaccacctgcttggccccgcggcccggctgctgctgcagggcgtggggctgtcggtcgaggacgtgacgcccacggggccgcacggcgtcgtgaccaagggcgacgtcctggcggcgatcgagagcggcgccaagcccgcgccgaagaaggaggaggcgaagaagagcgagaaggtggtcgcgaagaaggaggcggcaacccccgcgcaggaggccgcggcggcgccgtcgggcggccgcgcgcggcgccagcgcggccagtacacggacgtgcccaactcgcagattcggaagatcatcgccagccgcctgtccgagtccaagtcgaccatcccgcacctctacctctccgcggacgtggacctgaccgcgctggcggcgctgcgcgccgcgctcaaggcgcagggcctgaagatctcggtcaacgactgcgtggtcaaggcggccgcgggcgcgctggcggccgtccccgcggccaacttccactgggacgacgccgaggagcgggcgcgggcggtgcggagcgagggcgtggacatctccatcgccgtggccacggacaagggcctcatcacgcccgtcgtgcgcggcgccgacggcaaggccttaaccgccgtggcgtccgagatccgggagctggcgggccgcgcgcgcaagaacaagctgcggccggaggagttccagggcggctccttctccatcagcaatctgggcatgtttggcatcgacagcttctgcgccatcatcaacccgccccaggcctgcatcatggccgtcggcgcggggcgcgaggagaccgtgctcgtggacggccggccccagaccaagaccatcatgacggtcaccctctccgcggatcacagggtctacgacggtgaaattgcgtcggcgctcctggagtccttcaaggccaagatcgaggcgccctacacgctcctcctggcttga

SEQ ID NO: 243 - protein, 437 aa, Prototheca moriformis
MPALSPTMSQGNLVEWTVKEGQEVAPGDSLAEVETDKATMTWENQDDGFVAKILVPAGAQGIEVGTPVLVLVEDEADVAAFKDYKPQGQAAAAGDNKEEGSESKAPAAKAEKASAASGVARNDHLLGPAARLLLQGVGLSVEDVTPTGPHGVVTKGDVLAAIESGAKPAPKKEEAKKSEKVVAKKEAATPAQEAAAAPSGGRARRQRGQYTDVPNSQIRKIIASRLSESKSTIPHLYLSADVDLTALAALRAALKAQGLKISVNDCVVKAAAGALAAVPAANFHWDDAEERARAVRSEGVDISIAVATDKGLITPVVRGADGKALTAVASEIRELAGRARKNKLRPEEFQGGSFSISNLGMFGIDSFCAIINPPQACIMAVGAGREETVLVDGRPQTKTIMTVTLSADHRVYDGEIASALLESFKAKIEAPYTLLLA

SEQ ID NO: 244 - DNA, 309 bp, Prototheca moriformis
atgtcgagcgacttggagcccaagttcaaaaaggccgtgtggctgatccgcaacggacccccggccgagggcgccaccaccgagaccaagctgctctactacgcgcactacaagcaggccacggagggcgatgtcacggggtcgcagccctggcgggcgcagttcgaggcccgggccaagtgggacgcctgggccaagctcaagggcatgagycgggaggaagctatgcagaaatacatcgacctcatcagcaagtccagacccgactgggagaacaaccctgctctcaaggactaccaggaggagtag

SEQ ID NO: 245 - protein, 102 aa, Prototheca moriformis
MSSDLEPKFKKAVWLIRNGPPAEGATTETKLLYYAHYKQATEGDVTGSQPWRAQFEARAKWDAWAKLKGMSREEAMQKYIDLISKSRPDWENNPALKDYQEE

SEQ ID NO: 246 - DNA, 1220 bp, Prototheca moriformis
gctcggcctcctccacctcgccctccttctcctccttggcctcctcatcacaagttcaatttttgatcacttgcatgtatacgttgtttcgatacacgacatcggctctgggtccctcgagagttcactgatccgtcccacttgcgggccgcacggtgcgatgagcgccgcgcgcgaggtgcaggaggaggaggaggaccatttcgaggcggcggccgagcaactgaccgtgaccatcgcgacgggcacgagactgccggacgcctccctgctggagctgtacgccctgtacaagcagggctcggaggggccctgctccaggcccaagccgtccttcctggatcccaagggccgaaccaaatggaaggcctggcacgacctgggcgccatgccccgcgatgaggccagggacaagtacgtcgtcgcggtgcggcgactgctgggcggcgcgcctgagggccagccgcagccggcggcctacggcagcacgggcccggcggtgagcaccccggcccgcgccctcggcgaggaggcgggggacgcggtgggcgagggggccgacgacgtggggcccctccacgcggcgctggccgatggagacgcggcgcggttcgcggccgccgtcgccgaggccacgaccggccaggccgagcggcgggacgcggaggggggcacccccctccacatcgccgcggatgccggcaacgtcgaggccattgacctcctgagagccaagggagtcgacctggatctgaaagatcaggacggcatgacggcgctgcactatgcggcgctggcgagccagcgagaggcgtacgaggccttgcttgaagcgggcgcggatagcagtgtccgagacgccgagggccagtcgcccgccgacctggcgcccccggactggaaccgcgcgtgacgggtgggttgtatgccaaaacatttggagactggagtttcccaatcggtgactggccccgcgcttcgtgccaaattctagacaatttcatgagtcagagagagacggctcgggtgcggctgcaacagactgcgctttctgtaagcaaggcactctcgacagatggcgctcccgatgccgggcgcgagcgcgcgcatcgctaccctgcgcgctgcgcttctccctcctcctcgtgcaggaggcggagccgcgcggcgcggatgacgttgtgcatggtggcggcgatggtcatgggcccgatgccgcc

SEQ ID NO: 247 - protein, 303 aa, Prototheca moriformis
LGLLHLALLLLLGLLITSSIFDHLHVYVVSIHDIGSGSLESSLIRPTCGPHGAMSAAREVQEEEEDHFEAAAEQLTVTIATGTRLPDASLLELYALYKQGSEGPCSRPKPSFLDPKGRTKWKAWHDLGAMPRDEARDKYVVAVRRLLGGAPEGQPQPAAYGSTGPAVSTPARALGEEAGDAVGEGADDVGPLHAALADGDAARFAAAVAEATTGQAERRDAEGGTPLHIAADAGNVEAIDLLRAKGVDLDLKDQDGMTALHYAALASQREAYEALLEAGADSSVRDAEGQSPADLAPPDWNRA

SEQ ID NO: 248 - DNA, 2132 bp, Prototheca moriformis
cgagccctggggccgtgcaccctttggagcagccaggtgcagcgacaccctttggtacgcagcctggccacaggcccctgcacttttacctagactacatctgattgaattttatgtatgcttgtcgtaatcgcgcatctcccggtgtgccccattgcctgcagtaggccttctcgatcgcttacccggctagcagcgtctgggtgcggtggatcgcctcggacgaccccaacttcccctacaagcccctggaggtgaacgccacgagcgtggtgcaccaccgcggcatggagctgctgcagaacccggtgttcaacaagggcaccgcctactctgtggccgagcgggagcgcctgggcgtgcgcggtctgctcccgccgcaggtgctgcccgtgtcgcgccagatggcgcgcgtcatggaccggtactggcacggctccgacttcatcagccccgaggagatcgagtcgggcggcatcacgcacgagcacacccgcaagtggctcgtcctgaccgagctccaggaccggaatgagacgctgttttaccgctgcctgatagaaaactttgtggagatggcgccgattctgtacacgccaacggtgggctgggcgtgcctgaactaccacaagctcttccgccgcccgcgcggcatgtacttctcggcctttgaccacggcaagatgtcgaccatggtgcacaactggccgcacgaggaggtggacgcgatcgtggtcacggacggctcgcgcatcctggggctgggcgacctcggctgcaacgggctgggcatccccgtgggcaagctggacttgtacgtggccgcgggcggcttccacccctcgcgcgtgctgccctgcgtggtcgacgtgggcaccaacaacgaggccctgcgcgccgacccgcagtacctgggcgtcaagcaggcgcgcctcgtgggcgacgcctactactccctgctcgacgagtttgtgcaggccgtcatgctgcgctggccgcacgccgtgctccagttcgaggactttgccatggagcacgcggcgccactgctggcgcgctaccgcaaccaccacaccgtcttcaacgacgacatccagggcaccgcctgcgtcgcgctggcggggctctacggcgcgctgcgcgtgctgggccgcgggcccgccgacctcaccggcctgcgcatcgccgttgtgggcgccggcagtgccggcatgggcgtcgtgtccatgatcgcgaaaggcatggagcagcacgggctgacgccggaggaggcggcggacaacttttgggtgctggacgccgacgggctgattacggaggagcgcgccaacctgccggcccacgtccggcgctttgcgcgctccgacgagcgcggcaccgacggcgagcgcctgctggagaccatccgccgcgtcaagccgacctgcctcatcggcctctcgggcgcggggcgcctcttcattaaggacgtgctccaggccatggcggaggtgacgccgcgccccatcatcttccccatgagcaaccccatcgccaagatggagtgcacgcaccaggaggccatcaagcacaccaagggcaaggcggtgtttgcctctgggagcccgcagggcccggtggagtgggagggccactcgcacgccccctcgcaggccaacaacatgtacatcttccccggcatcgcgctgggggcctggctggcgcggtcgggcacgatcacggaccgcatgctcatggcctcggcggaggccctggcccagtgcaccacgcccgcggagctcgccctcggcatggtctaccccagcatgacccgcatcagggaaatttcgctgagggtggccgaagcggtgatcgaggccgccggcgccttggcccagaacgagcgcctgctcaaggcaaaggccgaggggcccgaggccctgcgggactacatccaggcgcacatgtaccacccagagtacacaaccttggtctacaaagaaagccggtaaattgccgagcttgcttgaacgtctgatgttttggcccataatgaggcagcctctggccagcgcgtgcccttgctttcccttgctggtccttttaaagttggtttcgctccctatggtgtgtttgtgcgatgtgtagaaagt

SEQ ID NO: 249 - protein, 580 aa, Prototheca moriformis
LEVNATSVVHHRGMELLQNPVFNKGTAYSVAERERLGVRGLLPPQVLPVSRQMARVMDRYWHGSDFISPEEIESGGITHEHTRKWLVLTELQDRNETLFYRCLIENFVEMAPILYTPTVGWACLNYHKLFRRPRGMYFSAFDHGKMSTMVHNWPHEEVDAIVVTDGSRILGLGDLGCNGLGIPVGKLDLYVAAGGFHPSRVLPCVVDVGTNNEALRADPQYLGVKQARLVGDAYYSLLDEFVQAVMLRWPHAVLQFEDFAMEHAAPLLARYRNHHTVFNDDIQGTACVALAGLYGALRVLGRGPADLTGLRIAVVGAGSAGMGVVSMIAKGMEQHGLTPEEAADNFWVLDADGLITEERANLPAHVRRFARSDERGTDGERLLETIRRVKPTCLIGLSGAGRLFIKDVLQAMAEVTPRPIIFPMSNPIAKMECTHQEAIKHTKGKAVFASGSPQGPVEWEGHSHAPSQANNMYIFPGIALGAWLARSGTITDRMLMASAEALAQCTTPAELALGMVYPSMTRIREISLRVAEAVIEAAGALAQNERLLKAKAEGPEALRDYIQAHMYHPEYTTLVYKESR

SEQ ID NO: 250 - DNA, 2501 bp, Prototheca moriformis
ttttttttagggtatccagacttcaactgctaggttgatcagtgcataatacagtggtgaccacagctgtcgaggatgctctagggggcaccgtatccaggcgttctagcgaatcgacaattgcacgaatagaatctatcatgcgcgattgcgggcaggtgggggcgcatgaacagcttcgccagcccttgacgggagaaaaagctacatgcgcttcttgagacgcgcatctacagacgcgcatccagtcctgtacatcttcagatgcgcctcgtgagacgcgtggatccagacacgcacccctgccttcaggcggcgctggaggccttggcgtcggcggcgtcggcctcggccaggtggtcgatggcgcgcttgcagatgctggtcatggtggtctcggggccgtagacctcgatgtcgatgcccgtctcctggcccagcttgcgcatggcctccaggccggccctgtagttgggcccgccgcggcgcacgaagagcttgaggcgcgcgccgcggatggcgccctcgcgctcgcggatggcggcgatgatgccgcggaaggtggcggcgacgtcggtgaagttggcgatgccgccgccgatgagcagcgcgcgcgcgcggccgtcggcgccggcggtggcgcagtcgagcaggcgcagcgcgtaggcgtgcgtctcggccgcggagggcccgcccgagtactcggcgtagttgcccagctccgcggccgcgccgaggtcgccgaccgtgtccgcgtagatgacgctggcgccgccgccggcgaccatggtccacacgcgtccggacgggttgaggatgctcagcttcaggctcgcgcccgtgccctcgtccatgcccgccacggccgcctcggccgcgctcaggcggcggccaaagggcagcgggaactccaggccctcgccgccccacttcttggccgagcggaagcccgcggtgtcgtccagctcgccgcgcatgtccagcgggaaggggcgcccgtccggccccagcgtgaaggggttcatctccatcagcgtgaagtccaggtccacgtacaccgcgtaggcccccgcgatgaaggcctccagcccgggccgcacctccagcggcagcgtggccaccagcggcgccagcttctcgccggacagctcctcctccacgcccacgctgatcgtgcgcacaaggtcccagttgtcctcgatctccatgccgcccgcctccgagaaggagatgtccgcgcccgtgcgcgtgccctggatgcaaaggtagtactcctcctcgtgcggcacaaacggctcgatgatgaagcagtcgatcacacccttgaccgtgcccatgtcgatgaccttgcccatgcgctggccgataaactcctcagcgccggccaagtccagcttgaggcccacgaggtcgtgcttgccgcgctttccaaacagacaatcgggcttgaccaccagcgggacctgcgtcaaccaggggtgctcgcccaccaactcgccaaagttggtgtcctttttgacctgggccaccctgatgggcaggtccaggcccgccagacgcgccatgtgcgtcttcagcagcgtcttggagttgtactccctgatctttttgcgtgccatggcgatctaatgcgtccctggtcttggtggagccggagaggcctggacagaaagcgatcgcggggtcgctggcgggacgtccgcggacaacgaagcgcggcccaagccgaccagcacgcacccgtcaagcctcacggatgccgagcacgacgcgattcgtgactgttggagcggtaggtagccttgaatccagcaatacggccgtctggaacactgagcggcttgtgagcgacctcgcgcctatgcaataaggggttggtttcgagtgctgacgaggctctcctagcctcgggcacagtgggaattcctggccgccaaaaaggtcgcgagcagccccagtgggcgctttcagtgatgtacagagcagcccgagcgtttatcttacattttacttggtgacagtggatgggtgtttgaaatgaagttacctgtgtctgatcacttatgatgacaccagtgttggttggcacggcgaatgcatatggatggcatgcagaagaatacaccctccgtttttgctgctggcacaaattctcactgcaaagtctcatgtttattctgtgcagtcccttcttagttatagactcggtccaattacgaacaatttgcatgggatgggtgctcaactcattccctgccagataccacaaacagaccccaacatagccagactcatctattgttgcaagtcaaatcaagctgctcacaaaagtatgattatggtgggagcctgtgcttgctcaaagaatgtgatcacgaatggcgcagccctgcagcatttcccgtgaatatatatgtatataaacgaacacatccaggtattgcctgcagcgttattcattttagattgatcaagaaagagtaagcttttgtgtgttgttg

SEQ ID NO: 251 - protein, 436 aa, Prototheca moriformis
MARKKIREYNSKTLLKTHMARLAGLDLPIRVAQVKKDTNFGELVGEHPWLTQVPLVVKPDCLFGKRGKHDLVGLKLDLAGAEEFIGQRMGKVIDMGTVKGVIDCFIIEPFVPHEEEYYLCIQGTRTGADISFSEAGGMEIEDNWDLVRTISVGVEEELSGEKLAPLVATLPLEVRPGLEAFIAGAYAVYVDLDFTLMEMNPFTLGPDGRPFPLDMRGELDDTAGFRSAKKWGGEGLEFPLPFGRRLSAAEAAVAGMDEGTGASLKLSILNPSGRVWTMVAGGGASVIYADTVGDLGAAAELGNYAEYSGGPSAAETHAYALRLLDCATAGADGRARALLIGGGIANFTDVAATFRGIIAAIREREGAIRGARLKLFVRRGGPNYRAGLEAMRKLGQETGIDIEVYGPETTMTSICKRAIDHLAEADAADAKASSAA

SEQ ID NO: 252 - DNA, 2567 bp, Prototheca moriformis
gccgggggctgcgccctcatgcttcccgtggccctcattgtgaacaacctcagtcctcaccgtcgctacccgaccttctggtggtgaggggctgcagcgcctgtgttatcttaccgtggtgggtccacatgtcttgcgagcaacagtggccagcgcagacacgcgagtgcccacgtttagatatttatgccatctttctttgttgagtgagcatccacgccaatagctctcttcaggtgcaggcttttcattatatcattttgcgattcgcatgctggttcctgtgtgcatttacaatccaggtcgacaatttcttcccactggcaaacctgcactcatcgctaccccaccaaccgtggttgcctttttgcctcccattgagccattgccaatatataaaatataataccaaccctacgtcatcatatcatttattccatgtgcaaaccctcgctcgtaccaatgacaatgagaaaacaaggtggcgtccgcagtgctcaaggcaaagggggcggcggtttgccacgaccaccggggacgcctttcgaatgccgcgtcagcatggtgagcgggaggcattagcgagggattggccaaaagcggtcgcttccggcctcccagcccgtaccgggcccaaagccaatcgccaaggcctctacagcccacacgaaagaggtgctacaggcgctcagagcgaccgctcgatcacgatgcccacgtccccacgcacgccgggccgctacggccaggcgggccagctcttcagcaagcagacgcaggccatcttctacaactggaagcaactgccagtgcagcgcatgctggacttcgactttctgtgcggtcgcacccttccctctgtggcatgcattgtccagcccggcagccagcaagggttccaaaaggtcttcttcggcccggaggaggtggccatcccgcagtacggctcgatcgccgaggcggtggagcagcacccgcgcgcggacgtgctgatcaacatgtcgagtttccggagcgcgtttgagtcgtcgctggaggcgctgcagcagccgacgatccgcacggtggccatcatcgccgagggcgtgcccgagcgcgacaccaagaagctgatcgccgtggcccagcgcgcgaacaaggtcatcctgggcccggccaccgtgggcggcgtgcaggcgggcgccttcaaggtcgcggacgcggccggcacgctggacaacatcgtcgcctgcaagctgtaccgccccggcagcgtgggctttgtgagcaagtcgggcggcatgagcaacgagctgtacaacgtgatcgcgcgcgcggcggacggcatctacgagggcatcgccatcggcggcgacgcctacccgggttcgacgctgtcggaccactgcctgcgctaccagcacatccccggcgtcaagatgatcgtcgtgctgggcgagatcggcgggcgcgacgagtactcgctggtcaaggcgctggaggcgggcgccatcaccaagcccgtcgtggcctgggtgtcgggcacgtgcgcgacgctgttccagaccgaggtccagtttgggcacgcgggcgccaagagcggcggcgccgacgagtccgcgcaggccaagaacgcggcgctgcgcgcggcgggcgcggtcgtgcccgactcgttcgaggacctggagccgaccatcaagcgcgtctacgacgagctggtgggcgcgggcgcgatcgtgcccgcgccgctgccgccgccgccctcggtgccggaggacctcgcggccgccaagcgcgcggggcgcgtgcgcgtgcccacgcacatcgtctcctccatctgcgacgaccgcggcgaggagccgaccttcaacggagagtccatgagcgcgctcatggagcgcggcgccaccgtcgccgacgccatcggcctgctctggttcaagcgccgcctgccgccctacgccacgcgcttcatcgagatgtgcgtcgtgctctgcgccgaccatggtccctgcgtctccggcgcacacaacaccatcgtcaccgcgcgcgcggggaaggacctcatctcctccctcgtctcgggcctgctcaccatcgggccgcgctttggcggcgccatcgacggcgccgcgcagcacttcaaggaggcggttgagaaaggctgggagcccgacgagttcgtggagatcatgaagcgccgcggcgtgcgcgtgccgggcatcggccaccgcatcaagtccaaggacaaccgcgacaagcgcgtggagctgctgcagcgctacgcccgcgaacgcttcccgtccacccgcttcctggactacgccatcgaggtcgagggctacaccctgcaaaaggccgccaacctggtgctcaacgtcgacggctgcatcggcgcgctcttcctcgacctcctgcactcggtcggcatgtttgccaagcctgagatcgacgacatcgtccagatcggctacctaaacggcctcttcgtcctcgcgcgcgccatcgggctcatcgggcactgcctcgaccagaagcgcctggggcagcccctctaccgccacccctgggacgacgtcctctacacc

SEQ ID NO: 253 - protein, 619 aa, Prototheca moriformis
MPTSPRTPGRYGQAGQLFSKQTQAIFYNWKQLPVQRMLDFDFLCGRTLPSVACIVQPGSQQGFQKVFFGPEEVAIPQYGSIAEAVEQHPRADVLINMSSFRSAFESSLEALQQPTIRTVAIIAEGVPERDTKKLIAVAQRANKVILGPATVGGVQAGAFKVADAAGTLDNIVACKLYRPGSVGFVSKSGGMSNELYNVIARAADGIYEGIAIGGDAYPGSTLSDHCLRYQHIPGVKMIVVLGEIGGRDEYSLVKALEAGAITKPVVAWVSGTCATLFQTEVQFGHAGAKSGGADESAQAKNAALRAAGAVVPDSFEDLEPTIKRVYDELVGAGAIVPAPLPPPPSVPEDLAAAKRAGRVRVPTHIVSSICDDRGEEPTFNGESMSALMERGATVADAIGLLWFKRRLPPYATRFIEMCVVLCADHGPCVSGAHNTIVTARAGKDLISSLVSGLLTIGPRFGGAIDGAAQHFKEAVEKGWEPDEFVEIMKRRGVRVPGIGHRIKSKDNRDKRVELLQRYARERFPSTRFLDYAIEVEGYTLQKAANLVLNVDGCIGALFLDLLHSVGMFAKPEIDDIVQIGYLNGLFVLARAIGLIGHCLDQKRLGQPLYRHPWDDVLYT

SEQ ID NO: 254 - DNA, 2491 bp, Prototheca moriformis
gagtttcaagttgtgctctccacttccgcgcgcattgcgacgaattctcacgccctttgtgcaggtgtccagttccacatcgggaggcatggggggcccgccacctcggcgcgtcaaacggcgtcaggtagggcgggcacgctggcactcttgcccgatgacccgtaccgagcagtactgccatgcctcgggtcggagacggtcggcaccgcccctgatcgcgaccacttccaaatgatcaaacccttgcagacacgatggacgtcgcggcggtgatactgtcgccccagacaacgccgcgcctggccgcaggccgggtcggtgtcggacgctccgcgcaggcgcccagacgactgggtgccggtggcagcgaggacgaagaaagggatgtactggacctcaagcttccaggagtgggcgggacgcctctgtcgccctggaatgcggtgatcctggaggaccagccatcgacgaaggacgacgcacgtgccacgcaacacgatgagagtccacgccgacgggcttcccgccgcaagatctgaagaggctccgatttagagttccatggccaatggttttcttgtacaaatgatttacatgcagtactgttcgaacacacctctcgacaccgggcatatcgcctcgcagggcaatcgaaggccgtcaaatctggcggtagtcgtgggaagtgaccctgcccgggggggcaatccgtaccatcagcgaggtgcgcaggaccaggcacgtctgccgtatatttgagggcttccctaggggtcgagtcaccttgctcggcttcattttgcaggttttaccaaaaaacctgcttggcatttttcttaacagggcatcttgaggtgcgacatacctgataccgacgagctcgagccaacccttcgctcgctgcggcatttttgtaacggtcgaccacggagcattgcggcagcgataatgtccaatactacgatcaaagtactgtgctacaagtctctgacgcacagcgatgtgacgacggagattgccaagtctgggcgactggttctgccgagggcccaggtcacggcctgcctgcagcgcctcctggccctcggcagcgccggcggagccccaggcaagggtcgagcgggatctctgtgcggtgccgtccccttgttcatgcacgacatggagggcaaggtctggaactttcagctgaagacatggcacaacgttgtggcctctggaggccgggcaacctacgtgttggagaatactgctggttttgtgcacgaaaacaagcttcaaccgggaagctggctggctatttgcgagcaggacgaccgcctggtcctccgcaccgacatcgtcaagggccgcgatttcctgctccccgtggtggcgcccgcgaccacggtcaagaagccctcctcccccagttttgcgccctggtcctccaagagttcggacctctcggccgccagcatgaccctggtgagcctgggccacgacacgccctccagcagcgaggacaaggcctccgcgccgtcccccaccatcctgtcggtgccgctggtgcgcccgcgccccatgtacggcgccatcagcgtccagcaggtgccgcggttgggctgggcgctgagcatggtgccgcaccagccgcgcggccagccgtgctggtaaccccgggtcgcccttccggcgtgcttccaagcacacccctgccccttcccaagcccgcgcggcccgctccgcgcggcttcctccccccgaacccaccaacaacgtgacctcgacggccacgcccgtcggggctcgggaccttggcaccccttcagtcgcactaccccgtccccacccaataaccagtgtgcttggaaataaaccggcagcgtcctcagccgccaccagctcaccctcacccccgttcccttacgcgcccgcgggacgcccctcgtcccggcaagcccgggcgcacgttgcccaccctcgatgtctcacacgtgtactcgcccttttctcgatcgggctcccaagcttgtcaattttgccgcgcgcggcccctctcttgcactgtggcaccggacccaaactctcattatttttgttgcacttgaaccctgcacacccgaccttggccccaccggcaccttgcgcaagcccagagtgtcccgcaaattcattcttggtgcggctcggccgacttctgcccaaagcgcgcggccgccctcgtatagatactgctcttttctcttactgtgagatctccctcggtacccggggtcgcggctgccaggcgccgcagcaggccgccaggtggcgtaggccgaccagcgcccagagcaggttgagcaggtagaaaaagttggcgttcaggccgccaagatccagccacacatgggccacagcggcgtgcgtcgccagcagcgtcatccacaggcactgccaggcgctggggtcgcgccctctccgccgcagcacggccgcgctcgtcgccatgcacagcgccaggcca

SEQ ID NO: 255 - protein, 235 aa, Prototheca moriformis
MSNTTIKVLCYKSLTHSDVTTEIAKSGRLVLPRAQVTACLQRLLALGSAGGAPGKGRAGSLCGAVPLFMHDMEGKVWNFQLKTWHNVVASGGRATYVLENTAGFVHENKLQPGSWLAICEQDDRLVLRTDIVKGRDFLLPVVAPATTVKKPSSPSFAPWSSKSSDLSAASMTLVSLGHDTPSSSEDKASAPSPTILSVPLVRPRPMYGAISVQQVPRLGWALSMVPHQPRGQPCW

SEQ ID NO: 256 - DNA, 2728 bp, Prototheca moriformis
ggtttgagaggaacaatttggggatgggcggtggcactgggatgaggcactgggatgaggcgctcattgtcaaagaataaaacggaatggacgaatcggtcagggccgccagcaccggccagggcccaggaggcaggcgtttcaagggcgggaatggggcccccagctagtttcgcgctcgtcagccctccacgcctctggcaaacacgtcgatcactccgcggtggagctgcgcgttgatcgtgcggctttgaatgagctccccatcgacgttccagtggctctcctggccaaccgcttcgatgtgcaccgcgtgggcgggcaggacctggatgtaggacccgtgctgcccgcccgcctcgaggccgatgtgcgacatcctgagcagaaacttgaggtactggaggcggctgcaccgcctgatgagcaccaggtgcagcaggccgtcgctcaggtgaccatacttggcgacgccctttttcgacttgtcagagcggcagggcatgatgacgagcatgatgcctgcaaactcctgctccgggaggtgcacaaactctgctcgccgccgctcccagagctcctcggccgaggcggtgaaccccgccgcgccgtcgcggccctcgcgcccgccgcgcgcgcagaactcgcagttggcgaggcaggcgtggctgaagctggcccgacccggtccggcggccggggccaggtacgagacgcgcgcggcgtaggccctgttcgcggcgagcatcttggcgcccaccagctcgtaccgcgcgggccccagccagcgcaggcgctccgactcggccatgaggtcgcccatgaagccgtagctgaccatgcaggtcgcaaactcgggcaggcccggctcccgctccagacgcagcacatccagcgccacggcgtcgcccagcacgacgtgcaccgcggccgtgaaggccgaacgcgtgccgttgagcgtgcaggccacggcgtcggtgctgccggccgggatgtggccgatgcggaactgcgcccccggcgcgacggccgcgcacccggccgcgcgcaggcccagcacaccgttgacgatctcgtggaagagcccgtccccgcccacggccaccacgccgtcaaacgcgcggcgcgagggtgagcgcgagcgccgcggcttgtcgcggtcggcgccagcgggggacagggaacggcgctccgcgcccgcgtcagcgtcgctctcggcgccgccgccgatcacctggcgcacgatggtgacggcgtgctgcggctcctgcgtctccaccaccgcgaccttgatcccggcctttcggaagacgggcgccacggtggagctccaggtcgagggcgcctggcgcgagccgcccaccgggttcacgatcaccagcagccgccgcgggcgccaggtctgcgcccgcatgccggcttgcagctgggcgtgccacgcacgtagcagctcctcgtctgtggagaccagggtcacttggcgcggatgccagtacgaggggttggagggcgcgcgccgaaaggtgaagagcgtgagggcccaggccttctcgagccaggaacaccactggcgacggagcgacgagggcttgacctccgccgcgatgatctcttgcagcggcagcgactctgcacgctgcccgaagcctggcaagaggttgacgcagccgtccatctcaaacgcccagctcaagccgccctcgctgcccgccagatccagactgacttgcgccggcacgccgtccacctgcatcggcacgccctgcagctccgcctcgctgaggcgcttgggaaaggaggaggaccgcgatatcgaggggtgcatgagtgggggctgcctggggtgcgccatcaggctgggcgacgcattggtacctcgtgtccgatgcggagaagacagcgatcccgcccgggaagagggcaggctcacggaatcgtcgtccatgtgcgatgacgggcgctgaagcaccagctcggtgcagagaacgtcacggggagctccgcgcatgtcccactaccgacccaaccgcacgcagggagacggtccgtcaggcatgaacgcgatgcgcataaggaagcaacaaccatgcgtgtgtggcaatcgaacggcgaaatgggccgattcttggcaaaggggggaggctggcgagggacgcacaccgcgtcttccgtcggcatcacgtggatctgtcgttcatgcatcgggatgccttacatgcaaccattggcgccgaggcaggcgcgaatgagccgagcaacagtgtacgcacgccaggaatcaattatactgactagacatttctgccatgaacctttcgtactcgctctccacggcagcaggcgctggcggggcgggagcgggggcgggagggggagggggcggcggtggcgcctcgtcgtcggccatacccccgactggcgggggggggggcggcggcggaacgtcgtccgtgggcggcggtcccgggaccgccgccccgctagcgtcgtacatgccgtggtacgcgcccgcctgatcgggcgcgggcggcggcaccgccccgtactgcgcgccgtaggcgtacgggtcggcggcgccagggtaggccgcgtacgggtcggctggggcctcggcgccggggtacgcacccggcggcgggggcacggcgccgtacgccccgccgggcggcggcggcggcgggtaggcgccgccgtagggcggtggtggggcgccgtaccccgggccgta

SEQ ID NO: 257 - protein, 523 aa, Prototheca moriformis
MQVDGVPAQVSLDLAGSEGGLSWAFEMDGCVNLLPGFGQRAESLPLQEIIAAEVKPSSLRRQWCSWLEKAWALTLFTFRRAPSNPSYWHPRQVTLVSTDEELLRAWHAQLQAGMRAQTWRPRRLLVIVNPVGGSRQAPSTWSSTVAPVFRKAGIKVAVVETQEPQHAVTIVRQVIGGGAESDADAGAERRSLSPAGADRDKPRRSRSPSRRAFDGVVAVGGDGLFHEIVNGVLGLRAAGCAAVAPGAQFRIGHIPAGSTDAVACTLNGTRSAFTAAVHVVLGDAVALDVLRLEREPGLPEFATCMVSYGFMGDLMAESERLRWLGPARYELVGAKMLAANRAYAARVSYLAPAAGPGRASFSHACLANCEFCARGGREGRDGAAGFTASAEELWERRRAEFVHLPEQEFAGIMLVIMPCRSDKSKKGVAKYGHLSDGLLHLVLIRRCSRLQYLKFLLRMSHIGLEAGGQHGSYIQVLPAHAVHIEAVGQESHWNVDGELIQSRTINAQLHRGVIDVFARGVEG

SEQ ID NO: 258 - DNA, 2072 bp, Prototheca moriformis
tggagttcagacgtgtgctcttccgatctcgcgtggtgagcaagcctgcgccgacgtgtttggtttcttcttcatgttgttgctcggaggcgccgtcgattagtttgccacctgaccaccgtgcccacagtccccgaccagctcactggcactttactgcatgctcatgccgccgtcgatgctgaggacctggccggtgatgtaggcggcggccgggtcggtgaggaggaacttgaccagcccggcgacctggtcgggcgtgccgtagctgttgagcgggatcttggcgaggatggccttctcgacctcggggttgagcacgcccgtcatctccgactcgatgaagcccggcgcgatggcgttgacgagcaccttgcggccggccagctcgcgcgcgagggagcgcgtcatgccgatgacgccggccttggaggaggcgtagttgacctggcccgcgttgcccatgagcccgaccacggaggtgatgttgacgatgcgcccgcgccgcgccttggccatgaccttggccgcggcctggctcgcgtagaacacgccggacaggttgacgtcgatgacctgctgccactgctcgggcttcatgcgcagcagcagcgtgtcgcgcgtgatgcccgcgttgttgaccagcgcgtccacgcggccccaccggtccaccgccgccttgatcagcgcctgcgcgtcctcgatcttggacaggtcccccttgaccacgatcgcctcgccgccagaggcctcgatctggtgcgccacctcctccgcggccccgctggacgccgcatagttgaccagcaccttgccgcccgcggcgcccagcttgagcgcgatcgcgcggccaatgccgcgcgaggagcccgtcaccaccgtcacgccctgctccagctccttctggagggagacgccgttgggcgacgaggccacggaggcagcgatccatgccgatcaacagccggcttttcagaaccttaatcatgcagagctccgtgatgaacgtgccggcgaccctttcggcgggatgtgcccttagggcctccccccgcctgccggccgctcgcccggcgcagcacgctgccggtcgccggtcgccgggccagctgcaggtcacgcgcgccgctgcctccgtggcctcgtcgcccaacggcgtctccctccagaaggagctggagcagggcgtgacggtggtgacgggctcctcgcgcggcattggccgcgcgatcgcgctcaagctgggcgccgcgggcggcaaggtgctggtcaactatgcggcgtccagcggggccgcggaggaggtggcgcaccagatcgaggcctctggcggcgaggcgatcgtggtcaagggggacctgtccaagatcgaggacgcgcaggcgctgatcaaggcggcggtggaccggtggggccgcgtggacgcgctggtcaacaacgcgggcatcacgcgcgacacgctgctgctgcgcatgaagcccgagcagtggcagcaggtcatcgacgtcaacctgtccggcgtgttctacgcgagccaggccgcggccaaggtcatggccaaggcgcggcgcgggcgcatcgtcaacatcacctccgtggtcgggctcatgggcaacgcgggccaggtcaactacgcctcctccaaggccggcgtcatcggcatgacgcgctccctcgcgcgcgagctggccggccgcaaggtgctcgtcaacgccatcgcgccgggcttcatcgagtcggagatgacgggcgtgctcaaccccgaggtcgagaaggccatcctcgccaagatcccgctcaacagctacggcacgcccgaccaggtcgccgggctggtcaagttcctcctcaccgacccggccgccgcctacatcaccggccaggtcctcagcatcgacggcggcatgagcatgcagtaaagtgccagtgagctggtcggggactgtgggcacggtggtcaggtggcaaactaatcgacggcgcctccgagcaacaacatgaagaagaaaccaaacacgtcggcgcaggcttgctcaccacgcgagatcggaagagcacacgtctgaactcca

SEQ ID NO: 259 - protein, 310 aa, Prototheca moriformis
MQSSVMNVPATLSAGCALRASPRLPAARPAQHAAGRRSPGQLQVTRAAASVASSPNGVSLQKELEQGVTVVTGSSRGIGRAIALKLGAAGGKVLVNYAASSGAAEEVAHQIEASGGEAIVVKGDLSKIEDAQALIKAAVDRWGRVDALVNNAGITRDTLLLRMKPEQWQQVIDVNLSGVFYASQAAAKVMAKARRGRIVNITSVVGLMGNAGQVNYASSKAGVIGMTRSLARELAGRKVLVNAIAPGFIESEMTGVLNPEVEKAILAKIPLNSYGTPDQVAGLVKFLLTDPAAAYITGQVLSIDGGMSMQ

SEQ ID NO: 260 - DNA, 1987 bp, Prototheca moriformis
actcaatcgacccgcacgcgagtacgaaaagattccatggtgcgaaacgttgaatgccatagtttgtaacgggccaggcgtacgcgtgcgggtcgattgagttgacgtcccgtagccccgctgggcggtcacctgagtgaatttggagcgagccgcatccgacgacgggtacctgtcattcgaaacacccgtatcattacgggagttttgtattgccaaacttttataattgaactgcccgacagtacattccgcttggaaagcatgtcgtctcggatcgacatgggcgtgtcgacgtccgggagggtgggcaacccaatgactgagcgatcagccgcccaccaattgcgggcgaccgctgcacgcgtgccaagacggcatgcacccttcaaatccgccgcaaggcatcgcgggccagcggcgatgcgctcggcggcgtttgacgagctggtggcgctggcccgggccaaggaccccaccctgcccctgcccaagcgcaagccggccagcccgcgccccaagccccccaaggcgccctggctgcggcagcgcgccccccagggcgagcgctacgagtacctcaagcagcagctgacgggcctgaagctggcgaccgtgtgccaggaggcgcagtgccccaacatcggcgagtgctggtcgggcggcgccgaggggatcggcacggccaccatcatggtgctgggtgacacctgcacgcgcggctgccgcttctgcgctgtcaagacgtcgcgtgcgccgccgccgccggacgcggacgagcccgagaacacggccgcggcggtggccgactggggcgtcgggtacgtggtgctgacctcggtcgaccgcgacgacctgcccgacggcggcgcgggtcactttgcggccacggtgcgcgcgatcaagcgccggcgccccgaggtcctggtcgagtgcctgacccccgacttttcgggggacgaggcgctcgtcgccgagctggcgcggtgcgggctagacgtctttgcgcacaacgtggagacggtggcgcgcctgcagcggcgcgtgcgtgaccaccgcgccggctacgagcagacgctggccgtgctgcgcgcggccaagcgcgcctgcccctcgctgctcaccaagtcctccatcatgctcgggctcggcgagcgcgacgaggaggtcgagcagaccatgcgcgacctgcggggggcgggcgtggacatcctgaccctggggcagtacctgcagcccacgcaccgccacctggaggtccaggacatggtccacccagacgcctttgaccactggcgagaggtcggagaagcaatggggttccggtacgtggcctcgggtccgctggtgcggtcctcgtacagagccggcgagttttacgtggcagccatgctcagggaaggaaagcgcggcggcgcgggggcgcagttgtcgccctgaggcggcggtggcagtctcttgaggcttttgggtgcgcaatctcaaacacgtgtgtctgtcctgcgcgggaccgagaggcatcatattccgcacgagcgtgcatcatccggatgcaaacacctattctcgtattctaatcttgtgaattataggctggcgtcaccagctgctgaatcatgcgttttggaggcaccgcccctgaatatttggcggcccactgcaacgctgtaagaatcttcttgccctttcacccggaagttcaaatatctctgcgtaaacagcaggcgtagaaacagaaacgagcgacgcatggtagcgggaggaacgaaacaaggcgcgctgctcaggggcaaggggcattcgtcatcacagattccgcccagctcccaatttccccaaccactgctagatctggcgcgcgccgcggctgtcgaggcggaccacctgactggagttggtctccagcccgccgtggcggagaaaggcctcggacatggcgcgcgcgacgcgctcgccggtggccgggtccggcacgaccgccacggcc

SEQ ID NO: 261 - protein, 391 aa, Prototheca moriformis
MSSRIDMGVSTSGRVGNPMTERSAAHQLRATAARVPRRHAPFKSAARHRGPAAMRSAAFDELVALARAKDPTLPLPKRKPASPRPKPPKAPWLRQRAPQGERYEYLKQQLTGLKLATVCQEAQCPNIGECWSGGAEGIGTATIMVLGDTCTRGCRFCAVKTSRAPPPPDADEPENTAAAVADWGVGYVVLTSVDRDDLPDGGAGHFAATVRAIKRRRPEVLVECLTPDFSGDEALVAELARCGLDVFAHNVETVARLQRRVRDHRAGYEQTLAVLRAAKRACPSLLTKSSIMLGLGERDEEVEQTMRDLRGAGVDILTLGQYLQPTHRHLEVQDMVHPDAFDHWREVGEAMGFRYVASGPLVRSSYRAGEFYVAAMLREGKRGGAGAQLSP

SEQ ID NO: 262 - DNA, 7185 bp, Prototheca moriformis
  modified_base (3285)..(3285): a, c, t, g, unknown or other
  modified_base (3294)..(3294): a, c, t, g, unknown or other
atgacggtggccaatcccccggaagccccgttcgacagcgagggttcctcgctggcgcccgacaatgggtccagcaagcccaccaagctgagctccacccggtccttgctgtccatctcctaccgggagctctcgcgttccaaccagcagtcgcggtcgttcacttcgcggggggtgccagggaggacggacgtttcggatgagctggagcgccgcatcctcgagtggcagggcgatcgcgccatccacagcgtgctggtggccaacaacggtctggcggcggtcaagttcatccggtcgatccggtcgtggtcgtacaagacgtttgggaacgagcgtgcggtgaagctgatcgcgatggcgacgcccgaggacatgcgcgcggacgcggagcacatccgcatggcggaccagtttgtggaggtccccggcggcaagaacgtgcagaactacgccaacgtgggcctgatcacctcggtggcggtgcgcaccggggtggacgcggtcgactgcggggggcagatccggttcgtgcgcaccggggtggacgcggtgtggcccggctggggccacgcgtccgagttcccggagctgcccgagtcgctgggcgccacgccctcgcagatccggttcgtgggcccgcccgcggggcccatggcggccctgggcgacaaggtgggctccaccatcctggcgcaggcggcgggcgtgcccacgctggcctggtccggctcgggcgtgagcatcgcctacgcggactgcccgcgcggcgagatcccgcccgaggtctaccgccgcgcctgcatcgactcgctggaggcggcgctggcctgctgcgagcgcatcggctacccggtcatgctcaaggccagctggggcggcggcggcaagggcatccgcaaggtgctcagcgccgacgaggtcaagctggcctacacccaggtctgcggcgaggtccccggctcgcccgtgttcgccatgaagctcgcgccgcagtcgcgccacctggaggtccagctgctctgtgacgcgcacggccaggtctgctcgctctactcgcgcgactgctccgtgcagcgccgccaccagaaggtggtggaggaggggcccgtcaccgccgcgccgcccgaggtgctggagggcatggagcgctgcgcgcgctccctggcgcgcgccgtcggctacgtcggcgccgccacggtcgagtacctctacatggtcgagacgcgggagtactgcttcctggagctcaacccgcgcctgcaggtggagcacccggtgacggagatgatcacgggcgtgaacatccccgccgcgcagctgctcgtcgcggccggcgtgcccctgcaccgcatccccgacatccgcaggctgtaccgcgcgccgctggccgaggacggccccatcgactttgaggacgacgccgcgcgcctgccgcccaacgggcacgtgctggcggtgcgcgtgacggccgagaacgcgcacgacggcttcaagcccacctcgggcgcgatcgaggagatcagcttccgctccacgcccgacgtctggggctacttctcggtcaagggcggcagcgccgtgcacgagttcgccgacagccagttcggccacctgttcgcgcgcggcgactcgcgcgaggcggccgtgcgggccatggtggtggcgctcaaggagatcaagatcaggggcgagatccagacgcccgtcgactacgtcgcgcgcatgatccagaccgacgacttcctgggcaaccgccaccacacgggctggctggacgcgcgcatcgcggcgcaggtcggcgccgagcgcccgccctggttcctggtcgtcatcgcgggcgccgtgctgcgcgcgacgcgcgccgtgaacgagcgcgcggccgcctttttggaccacctacgcaagggccagctcccgcccagcgaggtcccgctcacgcgcgtggccgaggagtttgtggtcgacggcaccaagtacgcggtcgacgtcacgcgcacggggccgcaggcctaccgcgtcgcgctgcgcgaccccgagggcgacggcgcccccgggcacgcgcgccgcgagagcctcgcctccgcggccggcgcggccagctccgtcgacgtcatcgcgcgcacgctgcaggacggcggcctgctgctgcaggtgcgacgggcgcgtgcacgtgctgcacagcgaggaggaggcgctgggcacgcgcctggtcatcgactcggccacgtgcctgctcagcaacgagcacgacccctcgcagctcgtggccgtcagcacgggcaagctcgtgcgccacctcgtcgccgagggcgagcacgtgcgcgcggacgagccctacgccgaggtcgaggtcatgaagatgatgatgacgctgctcgcgccccgcggccggcgcggtgcgctgggaggtggccgagggcgccgcgctggcgccgggcctgctgctcgcgcgcctggaggaagctgggacgaccctcccgccgtgcgcccgcgagcccttccgcggcgccttccccgacctgggcccgccctcgcccgactttgacggcctggccgcgcgctaccgctccgcgctcgaggccgcgcaggacgtgctcgacggcttcgagggcgacgtgcccgcggtcgtcgccgcgctgctggccgcgctggacgaccccgcgctctccctcgtcctgctggacgaggcgctggccgtggtcgcgccgcggctgccggccgcgctggccgcgcgcctggaggccgcggctggccgagggcgccgccgagatggcgggcgagctctcggacgacgagcaggacgccgcgctggcggcgccgggtcgccgcgcgaagggaggggcctccacgcgcgcttcgtggtcaagcgccgcgacccggcggcgcgcctgcagccgcgcgtcttcgaggagggccgccggcgcgcggcgctggcctcgccgcctcctgctcgagcgctacctggacgtggaggagcgcttcgagtccggcggcgccaagacggaccaggaggtcatcgacggcctgcgcggcacgcacagcgccgacccgggcaaggtgctggagatcgtggtcgcgcaccagtcggccggcccgcgcgccgacctggtgcaccgcctgctcaacgcgctggtgctgccctcgcccgaggcctaccgccccatcctgcgccgcctggccgcgctgacgggcgccggcagcgccgcgcccgcgcagcgcgcgcgccgcctgctggagcacagcctgctgggcgagctgcgcgtgctggtcgctgcgcgcgcngtccggccntggacatggttcagcgacgccgcgctgcgcgggctgtgcctgggcgagtcgccgggcgagcccgtctcgccgcgcgcggagctggccagcgcgctcgcggccgagtcctcggtcgcgtcgcccacctcgcggcggtccacgctcgcggaggggctctacgtcggcctgggcaacctggcggctgccgccgcgagcagcgtggaggcgcgcatggccatgctggtcgaggcccccgccgcggtcgacgacgcgctggccacgctgctggaccacccggacccggtgctccagcgccgcgcgctgtccacctacgtccgccgcatctacttcccgggcgtgctgcacgagccgcaggtcgtcgggcgtcgggccggcgcgcggtccgtccgcgtctgggcgacgcggggcgcgcccggcgcgatggcgccgcggcccagcaggaccagcatggccgggctcgcgccggggacgctgcacgtggtcctgaccgccgagggcgccgccgcgctgcagctggacgccgccgcgcaggccgcgctgggcacgcttgacgtctccggctacgtcgcgcccgagcaccagcagcagccggggctgccggacgcctcggtcgtcgcggccagtgccgccgccgcggtgtcggcgctcgcgcccgcgctgcgcgaggccggctacagcgccgtctccttcctcaccaagcgcggcggcgtcgagcccctgcgcgtcgtgttttacgacggcacgtcgagcggcagcgctgccgcgcccgactcctcgtccacccaaactggccatcgaccggctggtccctggaccccgtgctcggcacggtcgagccgccgacggccgaggcgctggagctggcctgtctggccggccgcgcgggcgcctcgcacgacgcctcgcgcaaccgtggcacatgtggaccgtggccgagcgcgccggcaagcgcagcgcggtgctgcgccgcacctttttgcgcggcgcggtgcgctcgctgggccggccggcgctgctgagcgcggcctacgcgggaacggccccgctgtcgcggcggcggcgctggccgagctggagcagacggtggaggcggcggccgccgagctggagcggctgggcaagggccgcgtgggcggcgcctcgtcccgactggacgcaccgtgcttgtcggtgctgatgctcgctgccgctgggcgcgtccgagccgcgcgaagggaaaggcgccgtcgcgcgcgcgctggccgcgccgcggccatcgcctcgcgccacgtggcggccctgcgccgcgcggcgctggcgcagtgggaggtctgcctgcgcaccggctcgggcggcgcctcgcaccgcgagggcggctggcgcgtggtcgtgtcctcgcccacggggcacgaggccggcgaggcctttgtggacgtctaccgcgaggccgccgacggcacgctgcgcgcggtcaaccccagcctgcgcgcgccgggcccgctggacggccagtccgtgctcgcgccctacccgacgctcgcgccgctgcagcagcgccggctgacggctcggcggcacaagaccacgtacgcgtacgacttcccggccgtattcgaggacgcgctgcgctcgatctggctgcagcgcgccgtggagctgggcgccaccgggctggaggccgcgcgcgaggacctgctgccgcccgggaccgcctggtcacggccggagctggtgctggacacggaggaggcgatctacgaaaacggcgccgcgcacattcgcctgaccgaccgcgcgccctcgatgaacgacctcggcgtcgtggcctggcgcctgacgctggccacgcccgagtgcccgcgcggccgcgccgtcgtggccatcgccaacgacatcacctacaactccggctccttcggcccgcgcgaggacgccttcttcaaggccgccaccgagtacgcgctggccgagcgcctgccggtggtctacctggcggccaactccggcgcgcgcgtcgggctggccgaggaggtcaagcgctgcctgcgcgtggagtggagcgtgccgggcgacccgaccaagggccacaagtacctctacctggacgacgaggactaccgctccatcacgggccgcgccgcgggccgcacgctgcccgtcagctgctcggccaaggtcggcgccgacgggcgcacgcggcacgtgctgcacgacgtcatcgggctcgaggacgggctgggcgtcgagtgcctgagcgggtccggggccatcgccggcgcctttgcgcgcgccttccgcgagggcttcaccgtcacgctcgtgtcggggcgcaccgtgggcatcggcgcctacctcgcgcgcctgggccggcgctgcgtgcagcgccgcgagcagcccatcatcctcaccggcttcgccgcgctcaacaagctgctggggcgcgaggtgtacacctcrcagcagcagctgggcggcccgcgcgtcatgggcgccaacggcgtcagccaccacgtcgtggacgacgacctgcagggcgtgcacgccgtgctgcgctggctggcctacacgcccgcgcgcgtgggcgagctgccgcccacgctgcgcgcggccgaccccgtsgaccgccgcgtgacctacgcgccggccgagaacgagaagctggacccgcgcctggccgtggcgggcggcgacgcgcccgagcccgtgacgggcctcttcgaccgcggcagctggaccgaggcgcaggcgggctgggcacagaccgtggtcacggggcgcgcgcgcctgggcggcatccccgtgggcgtggtggccgtggaggtgaacgcggtgtcgctgcacatccccgccgacccgggcatgcccgactcggccgagcgcaccatcccgcaggcgggccaggtctggttcccggactcagcgctcaagaccgcgcaggcgatcgaggagtttggcctggagggcctgcccctcttcatcctggccaactggcgcggcttctcgggcgggcagcgcgacctgttcgagggcgtgctgcaggcgggcagccagatcgtggagatgctccgcacctaccgccgcccggtsaccgtctacctgggcccggctgcgagctgcgcggcggcgcctgggtcgtgctcgactcccatcaacccggccagcatcgagatgtacgccgaccccaccgcgcagggcgccgtgctcgagccgcagggtgtcgtggagatcaagttcaggaccccagacctcctcgccgccatgcaccggctggacgaaaagatcatcgcgctcaagtcggacgactcgcccagcgcgctggcggccatcaaggcgcgagaaagcgagctgctgcccgtctacagccaggtcgcgcaccagttcgcgcagatgcacgacggccccgtgcgcatgctcgccaagggcgtgctgcgcggcatcgtgccctggtcggccgcgcgcgccttcctggccacgcgcctgcgccggcgcctggccgaggaggcgctgcttcgccagatcgcggcggccgacgcgtccgtcgagcacgccgacgcgctggccatgctgcgctcctggttcctcagctcgccgcccacgggcggcgcgcccggcgcgcccggcgcgctcggcgcgctgctcaaggagacggtcgtcgcgccgcccgacgcgggcgaggcgccgctggcgctctggcaggacgacctcgccttcctggactggagcgaggccgaggccggcgcctcgcgcgtcgcgctcgagctcaagagcctgcgcgtcaacgtcgccatgcgcagcgtcgacagactgtgccagaccccggagggcaccgccgggctcgtcaagggactggacgaggccatcaagtccaacccgtccctcctcctctgcctccgctcgctggtcaagccgtag

SEQ ID NO: 263 - protein, 2394 aa, Prototheca moriformis
MTVANPPEAPFDSEGSSLAPDNGSSKPTKLSSTRSLLSISYRELSRSNQQSRSFTSRGVPGRTDVSDELERRILEWQGDRAIHSVLVANNGLAAVKFIRSIRSWSYKTFGNERAVKLIAMATPEDMRADAEHIRMADQFVEVPGGKNVQNYANVGLITSVAVRTGVDAVDCGGQIRFVRTGVDAVWPGWGHASEFPELPESLGATPSQIRFVGPPAGPMAALGDKVGSTILAQAAGVPTLAWSGSGVSIAYADCPRGEIPPEVYRRACIDSLEAALACCERIGYPVMLKASWGGGGKGIRKVLSADEVKLAYTQVCGEVPGSPVFAMKLAPQSRHLEVQLLCDAHGQVCSLYSRDCSVQRRHQKVVEEGPVTAAPPEVLEGMERCARSLARAVGYVGAATVEYLYMVETREYCFLELNPRLQVEHPVTEMITGVNIPAAQLLVAAGVPLHRIPDIRRLYRAPLAEDGPIDFEDDAARLPPNGHVLAVRVTAENAHDGFKPTSGAIEEISFRSTPDVWGYFSVKGGSAVHEFADSQFGHLFARGDSREAAVRAMVVALKEIKIRGEIQTPVDYVARMIQTDDFLGNRHHTGWLDARIAAQVGAERPPWFLVVIAGAVLRATRAVNERAAAFLDHLRKGQLPPSEVPLTRVAEEFVVDGTKYAVDVTRTGPQAYRVALRDPEGDGAPGHARRESLASAAGAASSVDVIARTLQDGGLLLQVRRARARAAQRGGGAGHAPGHRLGHVPAQQRARPLAARGRQHGQARAPPRRRGRARARGRALRRGRGHEDDDDAARAPRPARCAGRWPRAPRWRRACCSRAWRKLGRPSRRAPASPSAAPSPTWARPRPTLTAWPRATAPRSRPRRTCSTASRATCPRSSPRCWPRWTTPRSPSSCWTRRWPWSRRGCRPRWPRAWRPRLAEGAAEMAGELSDDEQDAALAAPGRRAKGGASTRASWSSAATRRRACSRASSRRAAGARRWPRRLLLERYLDVEERFESGGAKTDQEVIDGLRGTHSADPGKVLEIVVAHQSAGPRADLVHRLLNALVLPSPEAYRPILRRLAALTGAGSAAPAQRARRLLEHSLLGELRVLVAARAVRPWTWFSDAALRGLCLGESPGEPVSPRAELASALAAESSVASPTSRRSTLAEGLYVGLGNLAAAAASSVEARMAMLVEAPAAVDDALATLLDHPDPVLQRRALSTYVRRIYFPGVLHEPQVVGRRAGARSVRVWATRGAPGAMAPRPSRTSMAGLAPGTLHVVLTAEGAAALQLDAAAQAALGTLDVSGYVAPEHQQQPGLPDASVVAASAAAAVSALAPALREAGYSAVSFLTKRGGVEPLRVVFYDGTSSGSAAAPDSSSTQTGHRPAGPWTPCSARSSRRRPRRWSWPVWPAARAPRTTPRATVAHVDRGRARRQAQRGAAPHLFARRGALAGPAGAAERGLRGNGPAVAAAALAELEQTVEAAAAELERLGKGRVGGASSRLDAPCLSVLMLAAAGRVRAARRERRRRARAGRAAAIASRHVAALRRAALAQWEVCLRTGSGGASHREGGWRVVVSSPTGHEAGEAFVDVYREAADGTLRAVNPSLRAPGPLDGQSVLAPYPTLAPLQQRRLTARRHKTTYAYDFPAVFEDALRSIWLQRAVELGATGLEAAREDLLPPGTAWSRPELVLDTEEAIYENGAAHIRLTDRAPSMNDLGVVAWRLTLATPECPRGRAVVAIANDITYNSGSFGPREDAFFKAATEYALAERLPVVYLAANSGARVGLAEEVKRCLRVEWSVPGDPTKGHKYLYLDDEDYRSITGRAAGRTLPVSCSAKVGADGRTRHVLHDVIGLEDGLGVECLSGSGAIAGAFARAFREGFTVTLVSGRTVGIGAYLARLGRRCVQRREQPIILTGFAALNKLLGREVYTSQQQLGGPRVMGANGVSHHVVDDDLQGVHAVLRWLAYTPARVGELPPTLRAADPVDRRVTYAPAENEKLDPRLAVAGGDAPEPVTGLFDRGSWTEAQAGWAQTVVTGRARLGGIPVGVVAVEVNAVSLHIPADPGMPDSAERTIPQAGQVWFPDSALKTAQAIEEFGLEGLPLFILANWRGFSGGQRDLFEGVLQAGSQIVEMLRTYRRPVTVYLGPAASCAAAPGSCSTPINPASIEMYADPTAQGAVLEPQGVVEIKFRTPDLLAAMHRLDEKIIALKSDDSPSALAAIKARESELLPVYSQVAHQFAQMHDGPVRMLAKGVLRGIVPWSAARAFLATRLRRRLAEEALLRQIAAADASVEHADALAMLRSWFLSSPPTGGAPGAPGALGALLKETVVAPPDAGEAPLALWQDDLAFLDWSEAEAGASRVALELKSLRVNVAMRSVDRLCQTPEGTAGLVKGLDEAIKSNPSLLLCLRSLVKP

SEQ ID NO: 264 - DNA, 592 bp, Prototheca moriformis
atggaggagccggaccaacaggaccctgcgggctccgggaccacccaggccgaggctgaaaagaggagtgcatccccaaagcccgtcagcgaggccaccagcgacggcaaggcctcctccgtggccacggcggccgaagccaagcccgaaagctctccaggcgaggatgtggccgccctctaccccggcatccccgtcctgccggacctgggccggttgcgggacaaccggcgcgacgtgcccctgacctgccaggtggtgggctgcggcgagagcctcagcgggcacgccgagtactaccggcggtaccgcgtctgcaagcgccacctcaagggctcggcgctgatcgtggacggggtgccgcagcgattctgccagcagtgcggtcgcttccacctgctggaggcctttgacggcgagaagagaaactgccgcgcccggctggaggagcacaactcgcggcggcgaaaggtcatggcgccggggggcggcggccaggtgacgggcgcgcgcgcgacgcgccgggagtcggagcggcacggccgcggcatggacctgcgcggcgccgggctcgaggtcgctcggtcgcccg

SEQ ID NO: 265 - protein, 197 aa, Prototheca moriformis
MEEPDQQDPAGSGTTQAEAEKRSASPKPVSEATSDGKASSVATAAEAKPESSPGEDVAALYPGIPVLPDLGRLRDNRRDVPLTCQVVGCGESLSGHAEYYRRYRVCKRHLKGSALIVDGVPQRFCQQCGRFHLLEAFDGEKRNCRARLEEHNSRRRKVMAPGGGGQVTGARATRRESERHGRGMDLRGAGLEVARSP

SEQ ID NO: 266 - DNA, 2313 bp, Prototheca moriformis
cgcaaagggtgttcagtggtcgatggggacgaacttgacgtcctcgtagcctgggaagctgggcgcgtagcgtgcgaagaggtcctccagcgaggcgtagaaccgcgcgtggacgtcgtcgatctgggcctgcgaggggccctctggcgccacctttgtcgccgggaggatgggcttgccgatcacaaacctgagtcctgtggggcgggggaagggcgacacctggtagcgcccgccgatgaggtagggcacggggaagcccaggcgcttgtaggtccagcgcagcatgcccggcaggttgaccaggttttggagcgagtcgacctcgcccagcgccagcaccggcacgagcgcggcctcgctctgcagcgccagccgcacaaagcccttgtggctgcggaacacgcaaaactcccgcgtcggccgcgcgatgcggtgcgtgtgcaccagctcggcctggccaccggggacgagcagcacggcgcccttctcgcgcagcgcgcggaggaaggatcgccgcgagacgacgcgcaggccgagccaggccagcaggtcgcgcagcaagggcaccgcaaacacgatcgaggcgcagagcgtcacggggcggatgccggggagcaggcgccggaagccgggcagcagcggcaggtagccggccgccagcgggtacagaccgtgcacggcaaagccaaagacgtggcggcgctcggggtcgtactggtccgcctcgccgtcgcgcaggatctccagcgaccctacccaggccgggagcacctcctccgaccgccgcccaaaccagtcccggaacagcggccactcccgccggcctgtctcgccaaagggcccgccaatcagggtgatgctgtagtacacaaaggccgaagcgagcaggagcgtcagggcaatctccagcggaaagagaagaaagtagagcgcaatgattgtgcacagcaactggaccggggcgtagaggagggtgatgacaagggcgtcggagagccgggtccgtaggtcggtcggccgcagcgcgcgctccgagagcgacgcgctgagtccgcgcacgagctccatggtccgcacggggcccttgtacagcaacagcgagccggccagcaccaggtgggagaagaccatgaagatgcctgcggtctgggcaaagcgctgcgcgctgtgcacgatgccgatggtgctgtgggccatgaggtagatgatgaggctcagccccgcggagtagagcgcccaccccagggcctgcgtggccacgaaccagccgccgcccttgaagggctggaaaaagtgccatgcggccggcgcggcctcatcgccgccctcggagtcgctctcgctgccgggctcggacttgcgatgcacgtgccgcaggtggcccgccagcccgtaggtcacaaaggcggccatggtcaagcatgcgcccgagagcgccaggtacgccagccgcacgggcgcgtcctccagcaggttggcgcccaggtgcagcagcgcggcgcccagcgcgacccagagcgaccccatcccgatcacgacgtacgaggccgcggcggacgacggcagcgacttgacgtcccacaagacatcggtgtggccctgctggagacccgcgaggatgcgcatgggcttggccgcggggtcaaagaccagcacggcagacacctggaagagctgggaggacacggctcccacggccgcggcggccaccagcagctccaccgtcaggctagacatccaatcgtgccgcgcggccgacagaatgggcaccactacggcgcagctcaggagccaagctgagaaggacatggcctggaagacgagggtgcgtaccccgcccatcgtgccccagctccacccgggccggacctgggtcttgcccctgcccagctgcacggcgcggtgcagccatcgcgccccgccaacgtaggtgaggggcgtggacaccgcgaacaccacccagcaggccgccaggcaaatgaccacgtggtcgccggagaggaccgactccgagagggagtggctcaccgacgtcatagcaagggccctcgtccgtcagacagactcattcgatgcacatccctgctcccgcggtgggaatgaggttgggaaaaagatgggatcgacctgggaatggaagcgaactgccaggaaggcatcgtcaccgggggttccgacaaccatatcgtcattgatgcatcggggcctccggggaggcgtctgccgccggacatgggagcgatcaggcgaccggagtgtttaagcgagcacacgaccagcaccgtcgttgagcctcgaaagtgatgcaaa

SEQ ID NO: 267 - protein, 675 aa, Prototheca moriformis
MTSVSHSLSESVLSGDHVVICLAACWVVFAVSTPLTYVGGARWLHRAVQLGRGKTQVRPGWSWGTMGGVRTLVFQAMSFSAWLLSCAVVVPILSAARHDWMSSLTVELLVAAAAVGAVSSQLFQVSAVLVFDPAAKPMRILAGLQQGHTDVLWDVKSLPSSAAASYVVIGMGSLWVALGAALLHLGANLLEDAPVRLAYLALSGACLTMAAFVTYGLAGHLRHVHRKSEPGSESDSEGGDEAAPAAWHFFQPFKGGGWFVATQALGWALYSAGLSLIIYLMAHSTIGIVHSAQRFAQTAGIFMVFSHLVLAGSLLLYKGPVRTMELVRGLSASLSERALRPTDLRTRLSDALVITLLYAPVQLLCTIIALYFLLFPLEIALTLLLASAFVYYSITLIGGPFGETGRREWPLFRDWFGRRSEEVLPAWVGSLEILRDGEADQYDPERRHVFGFAVHGLYPLAAGYLPLLPGFRRLLPGIRPVTLCASIVFAVPLLRDLLAWLGLRVVSRRSFLRALREKGAVLLVPGGQAELVHTHRIARPTREFCVFRSHKGFVRLALQSEAALVPVLALGEVDSLQNLVNLPGMLRWTYKRLGFPVPYLIGGRYQVSPFPRPTGLRFVIGKPILPATKVAPEGPSQAQIDDVHARFYASLEDLFARYAPSFPGYEDVKFVPIDH

SEQ ID NO: 268 - DNA, 1500 bp, Prototheca moriformis
ctcctcccagccaccgtccaccaaatcccacctctcgcccgctcagacgttgatgtaggtgccgcagatgtcggagcggcggaagatgccgtactgctgcaggcactgctcccagagcccagagggcagcttgctggcgccggccagggcgccgatcaggcccgcgttgttctccacgcccacgtaggccgcggtcgtgtcgcgcgtgtccacaaagttgtccgagctggccgtgccgtacacgagcgcgcccgtgagcgtgtgcgtgtcggggtcgggcgacagcagaccggtcacgcggttgcacacctctggctcggccgggcaggccgcgtcgcggtcctgcgtgcgcttgggcgggttcttgccaaagccgacgacgagcgagcgccccgagtcgcccagcacgtagcggatctggctcaggccccagcactggtactcaaacacgcgcgtcgacccggggtcgttcagcgagtccgcgtaggccagcgccgcaaaggccgtgttcatggtggagcccagcggcgcgctcatggggttgtaggcgcggcccttgagcgtgtagttggccgccaggtcggagcagatccaggacttgaggaacagctccgactggctctggaaggtcacgccgcccgtctcctgcgccagcagcacgttggtcggccagaacacgttgtcccagtcaaacgcgtacttgaagtcgctcaccgacgactcgtactccaggtggttcacgtactggctgtacatgttggtcaggtactgctgctcccccgtcgccttgtacatccagctgctcgaccacgccaggtcgtcgtaaaacgtgctcgagttgtacaccttggaaatgttccagtcctgcaccgagtagtggcccaggtcggtggaggcgatgtcgtacacggccttggccttggtcagcagctccgtcgcgtaggccgcgtcgccgctggcgttgaacacgatggaggccgaggccagcgccgccgcgacctggccgcccaggtcgctcgcgcccttggccatgtccaccacgtacgcgggccggtccgtggtgtagtcctccagacggtaccagttgagctcctcctgctggatgttgccaatcctggacagaatgtaggtggtgttgctcgtcgtctgcaccgtcttgagcaggtagtccgtggaccagcgcaggttgtccagcagcgacgcggagctgcccgcgtccccgatggcctcgccgtaggtctggtaggcccaggacatgagcgtcgccgtaaaggcgatgggcagcgtggccttgaagttgccggccgccatgcccgtcacgtagccgccctccaggtcccaggtcgcgcccagcttgaccgcctgcggcaccgacttggtcgacgaggaggggctgatcgtggaaggcggcggcagggtggggatgagcgacgaaggcgaggagcccggggtgctgggcgacgagcccgccacgggcgaccacaccaggttggcaaacgg

SEQ ID NO: 269 - protein, 485 aa, Prototheca moriformis
PFANLVWSPVAGSSPSTPGSSPSSLIPTLPPPSTISPSSSTKSVPQAVKLGATWDLEGGYVTGMAAGNFKATLPIAFTATLMSWAYQTYGEAIGDAGSSASLLDNLRWSTDYLLKTVQTTSNTTYILSRIGNIQQEELNWYRLEDYTTDRPAYVVDMAKGASDLGGQVAAALASASIVFNASGDAAYATELLTKAKAVYDIASTDLGHYSVQDWNISKVYNSSTFYDDLAWSSSWMYKATGEQQYLTNMYSQYVNHLEYESSVSDFKYAFDWDNVFWPTNVLLAQETGGVTFQSQSELFLKSWICSDLAANYTLKGRAYNPMSAPLGSTMNTAFAALAYADSLNDPGSTRVFEYQCWGLSQIRYVLGDSGRSLVVGFGKNPPKRTQDRDAACPAEPEVCNRVTGLLSPDPDTHTLTGALVYGTASSDNFVDTRDTTAAYVGVENNAGLIGALAGASKLPSGLWEQCLQQYGIFRRSDICGTYINV

SEQ ID NO: 270 - protein, 467 aa, Prototheca moriformis
MQTAHQRPPTEGHCFGARLPTASRRAVRRAWSRIARAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDE

SEQ ID NO: 271 - protein, 400 aa, Prototheca moriformis; identical to SEQ ID NO: 62

SEQ ID NO: 272 - protein, 368 aa, Prototheca moriformis; identical to SEQ ID NO: 147

SEQ ID NO: 273 - protein, 368 aa, Prototheca moriformis; identical to SEQ ID NO: 77

SEQ ID NO: 274 - protein, 4 aa, Unknown
  source: /note="Description of Unknown: 'KDEL' motif peptide"
KDEL

SEQ ID NO: 275 - DNA, 22 bp, Artificial Sequence
  source: /note="Description of Artificial Sequence: Synthetic primer"
tgttgaagaatgagccggcgac

SEQ ID NO: 276 - DNA, 20 bp, Artificial Sequence
  source: /note="Description of Artificial Sequence: Synthetic primer"
cagtgagctattacgcactc

What is claimed is:

1. A recombinant nucleic acid comprising a coding sequence that encodes a *Prototheca* lipid droplet protein 1 having at least 95% sequence identity with SEQ ID NO: 120, wherein the coding sequence is operably linked to an exogenous nucleic acid sequence.

2. The recombinant nucleic acid of claim 1, wherein the protein has at least one amino acid substitution in comparison to SEQ ID NO: 120.

3. The recombinant nucleic acid of claim 1, wherein the exogenous nucleic acid sequence comprises a promoter.

4. The recombinant nucleic acid of claim 1, wherein the exogenous nucleic acid sequence comprises an untranslated control element.

5. The recombinant nucleic acid of claim 1, wherein the exogenous nucleic acid sequence encodes a targeting sequence.

6. The recombinant nucleic acid of claim 5, wherein the targeting sequence is a transit peptide selected from the group of a plastidial targeting sequence and a mitochondrial targeting sequence.

7. The recombinant nucleic acid of claim 1, wherein the nucleic acid is a DNA molecule.

8. The recombinant nucleic acid of claim 1 that encodes a functional *Prototheca* LPD1.

9. The recombinant nucleic acid of claim 1 that further encodes a sucrose invertase.

10. The recombinant nucleic acid of claim 1 that further encodes an inhibitory RNA that suppresses expression of a *Prototheca* lipid biosynthesis gene.

11. An expression cassette comprising a recombinant nucleic acid of claim 1.

12. A genetically engineered microbial cell transformed with a recombinant nucleic acid of claim 1.

13. A method for obtaining microbial oil comprising culturing a genetically engineered *Prototheca* cell of claim 12 under conditions such that oil is produced.

* * * * *